(12) United States Patent
Legrain et al.

(10) Patent No.: US 6,916,615 B2
(45) Date of Patent: Jul. 12, 2005

(54) **COLLECTION OF PROKARYOTIC DNA FOR TWO HYBRID SYSTEMS *HELICOBACTER PYLORI* PROTEIN-PROTEIN INTERACTIONS AND APPLICATION THEREOF**

(75) Inventors: Pierre Legrain, Paris (FR); Luc Selig, Fontenay-sous-Bois (FR); Jean-Christophe Rain, Puteaux (FR)

(73) Assignee: Hybrigenics S.A. (FR)

( * ) Notice: Subject to any disclaimer, the term of this patent is extended or adjusted under 35 U.S.C. 154(b) by 80 days.

(21) Appl. No.: 10/012,819

(22) Filed: Oct. 30, 2001

(65) Prior Publication Data

US 2003/0017478 A1 Jan. 23, 2003

Related U.S. Application Data

(63) Continuation of application No. PCT/IB00/00603, filed on Apr. 14, 2000.

(30) Foreign Application Priority Data

Apr. 30, 1999 (EP) .............................................. 99401066

(51) Int. Cl.$^7$ .......................... C12Q 1/68; C12P 19/34; G01N 33/53

(52) U.S. Cl. ............................ 435/6; 435/7.1; 435/91.1

(58) Field of Search ........................... 435/6, 7.1, 91.1, 435/91.2; 536/221, 23.1, 24.33

(56) References Cited

U.S. PATENT DOCUMENTS

| | | | | |
|---|---|---|---|---|
| 5,506,100 A | * | 4/1996 | Surzycki et al. | ............... 435/6 |
| 6,060,241 A | * | 5/2000 | Corthesy-Theulaz | ........... 435/6 |
| 6,403,337 B1 | * | 6/2002 | Bailey et al. | ............... 435/69.7 |
| 2003/0138771 A1 | * | 7/2003 | Pelletier et al. | ................ 435/5 |

FOREIGN PATENT DOCUMENTS

| | | |
|---|---|---|
| EP | 786 519 | 7/1997 |
| FR | 2 736 360 | 7/1995 |
| WO | WO 93 07273 | 4/1993 |
| WO | WO 96 12825 | 5/1996 |
| WO | WO 96 32503 | 10/1996 |
| WO | WO 97 37044 | 10/1997 |
| WO | WO98/25947 | * 6/1998 |
| WO | WO 98 26072 | 6/1998 |

OTHER PUBLICATIONS

Chien et al PNAS vol. 88 pp. 9578–9582 1991.*
Hudson et al. "The complete set of predicted genes from *Saccharomyces cerevisiae* in a readily usable form," Genome Research vol. 7, No. 12, Dec. 1997 pp. 1169–1173.
Bartel et al., "A protein linkage map of *Escherichia coli* bacteriophase T7," Nature Genetics US, New York vol. 12, No. 1 Jan. 1996 pp. 72–77.
Fromont–Racine et al. "Toward a functional analysis of the yeast genome through exhaustive two–hybrid screens," Nature Genetics vol. 16, No. 3, Jul. 1997 pp. 277–282.
Frederickson "Macromolecular matchmaking: advances in two–hybrid and related technologies" Current Opinion in Biotechnology vol. 9, No. 1, Feb. 1998 pp. 90–96.
Tomb et al., "The complete genome sequence of the gastric pathogen *Helicobacter pylori*," Nature vol. 388, Aug. 1997 pp. 539–547.
Fields et al. "A novel genetic system to detect protein–protein interaction," Nature vol. 340, Jul. 1989 pp. 245–246.
Keegan et al. "Separation of DNA binding from the transcription activating function of eukaryotic regulatory protein," Science vol. 231, 1986 pp. 699–704.
Marshall et al. "Unidentified curved bacilli in the stomach of patients with gastritis and peptic ulceration," Lancet 1984 pp. 1311–1314.
Hazell et al., "*Campylobacter pyloridis* and gastritis: association with intracellular spaces and adaptation to an environment of mucus as important factors in colonization of the gastric epithelium," J. Inf. Dis, vol. 153, pp. 658–663 Apr. 1986.
Leying et al., "Cloning and genetic characterization of *Helicobacter pylori* flagellin gene," Mol. Microbiol. vol. 6, No. 19, Oct. 1992 pp. 2863–2874.
de Bernard et al., "*Helicobacter pylori* toxin VacA induces vacuole formation by acting in the cell cytosol," 26 Molecular Microbiology No. 4 pp. 665–674.
Pagliaccia et al. "The m2 form of the *Helicobacter pylori* cytotoxin has cell type–specific vaculating activity," 95 Proc. Natl. Acad. Sci. USA 1998 No. 17 pp. 10212–10217.
Spohn et al., "Transcriptional analysis of the divergent cagAB genes encoded by the pathogenicity island of *Helicobacter pylori*," 26 Molecular Microbio. pp. 361–372.
Boren et al. "Attachment of *Helicobacter pylori* to human gastric epithelium mediated by blood group antigens," 262 Science 1993 pp. 1892–1895.
Tirode et al. "A conditionally expressed third partner stabilises or prevents the formation of a transcriptional activator in a three–hybrid system," 272 J. Biol. Chem. No. 27 pp. 22995–22999.

(Continued)

*Primary Examiner*—Kenneth R. Horlick
(74) *Attorney, Agent, or Firm*—Lerner, David, Littenberg, Krumholz & Mentlik, LLP

(57) ABSTRACT

The present invention concerns collections of recombinant cell clones derived from a prokaryotic genome, more particularly from *Helicobacter pylori* genome, useable for two-hybrid systems and methods to produce such collections. The invention further relates to then identification of *H. pylori* protein-protein interactions and to the application of said collections of recombinant cell clones and said identified proteins interactions to the pharmaceutical and diagnostic field.

4 Claims, 6 Drawing Sheets

OTHER PUBLICATIONS

Vidal et al. "Reverse two–hybrid and one–hybrid system to detect dissociation of protein–protein and DNA–protein interaction," 93 Proc. Natl. Sci. 1996 pp. 10315–10320.

Sharp et al., "Detection of two restriction endonuclease activities in *Haemophilus parainfluenzae* using analytical agarose–ethidium bromide electrophoresis," 12 Biochemistry No. 16 1973 pp. 3055–3063.

Altschul et al., "Basic local alignment search tool," 215 J. Mol. Biol. 1990 pp. 403–410.

Gish & States, "Identification of protein coding regions by database similarity search," 3 Nature Genetics No. 3 Mar. 1993 pp. 266–272.

Altschul et al. "Gapped BLAST and PSI–BLAST: a new generation of protein database search programs," 25 Nucleic Acids Research Sep. 1, 1997 pp. 3389–3402.

Tatusova et al., "Blast 2 sequences—a new tool for comparing protein and nucleotide sequences," 174 FEMS Microbiol. Lett. pp. 247–250.

Perricaudet et al. "La therapie genique par adenovirus," 23 La Recherche Apr. 1992 pp. 471–473.

Guatelli et al., "Isothermal in vitro amplification of nucleic acids by a mutienzyme reaction modeled after retroviral replication," 87 Proc. Natl. Acad. Sci. USA (1990) pp. 1874–1878.

Epstein "Les vecteurs herpetiques pour le transfert de genes," 8 Medecine/Sciences 1992 pp. 902–911.

Temin (Ed. Kucherlapati) Gene Transfer (New York Plenum Press) pp. 149–198 (1986).

Carter "Adeno–associated virus vectors," 3 Curr. Op. Biotechnology (1993) pp. 533–539.

Olins & Lee, "Recent advances in heterologous gene expression in *Escherichia coli*," 4 Curr. Op. Biotechnology (1993) pp. 520–525.

Buckholz "Yeast systems for the expression of heterologous gene products," 4 Curr. Op. Biotechnology (1993) pp. 538–542.

Edwards & Aruffo, "Current applications of COS cell based transient expression systems," 4 Curr. Op. Biotechnology (1993) pp. 558–563.

Luckow "Baculovirus systems for the expression of human gene products," 4 Curr. Op. Biotechnology (1993) pp. 564–572.

Compton "Nucleic acid sequence–based amplification" 350 Nature No. 6313, 1991 pp. 91–92.

Landegren et al., "Reading bits of genetic information: Methods for single–nucleotide polymorphism analysis," 8 Genome Research No. 8 (Aug. 1998) pp. 769–776.

Walker et al., "Strand displacement amplification—an isothermal, in vitro DNA amplification technique," 20 Nucleic Acids Research (1992) pp. 1691–1696.

Edwards & Leatherbarrow, "Determination of Association rate constants by an optical biosensor using initial rate analysis," 246 Analytical Biochemistry (1997) 1–6.

Kohler & Milstein, "Continuous cultures of fused cells secreting antibody of predefined specificity," 256 Nature (1975) p. 495.

Gietz et al., "Studies on the transformation of intact yeast cells by the LiAc/SS–DNA/PEG procedure," 11 Yeast (Apr. 1995) 355–360.

Wang et al., "An improved method for polymerase chain reaction using whole yeast cells," 237 Analytical Biochemistry (May 1996) 145–146.

\* cited by examiner

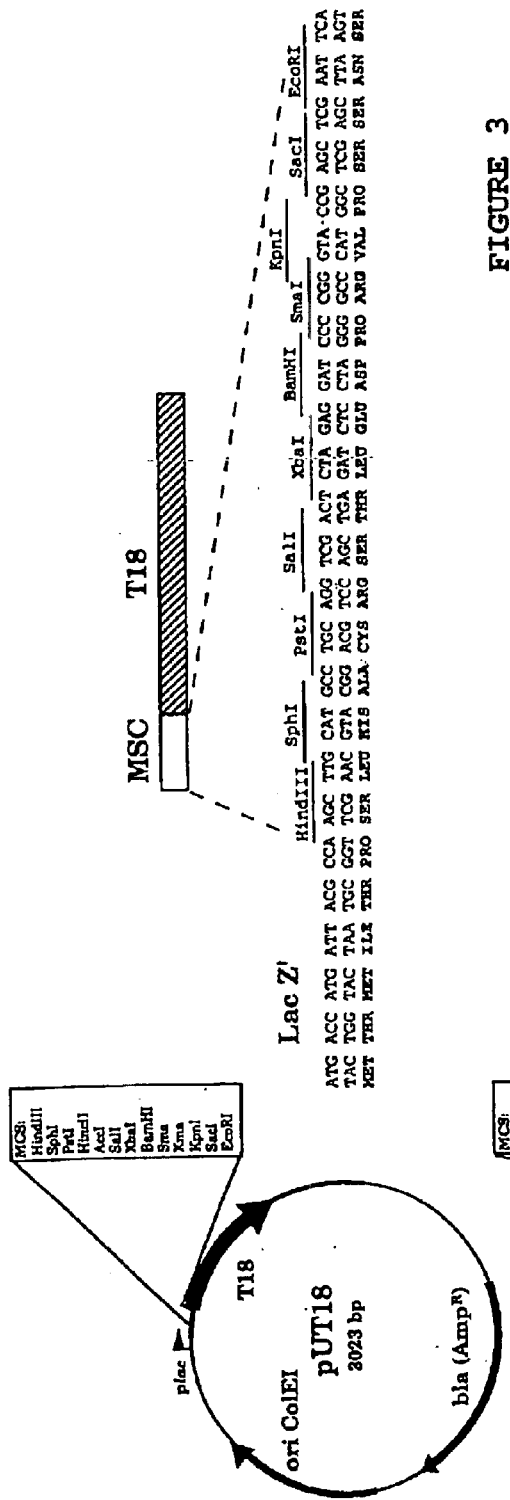
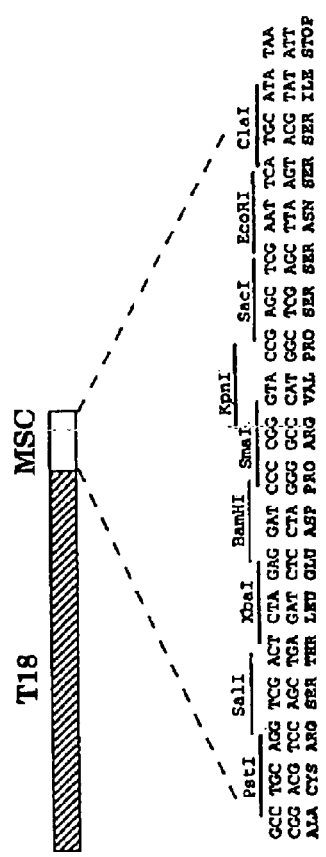
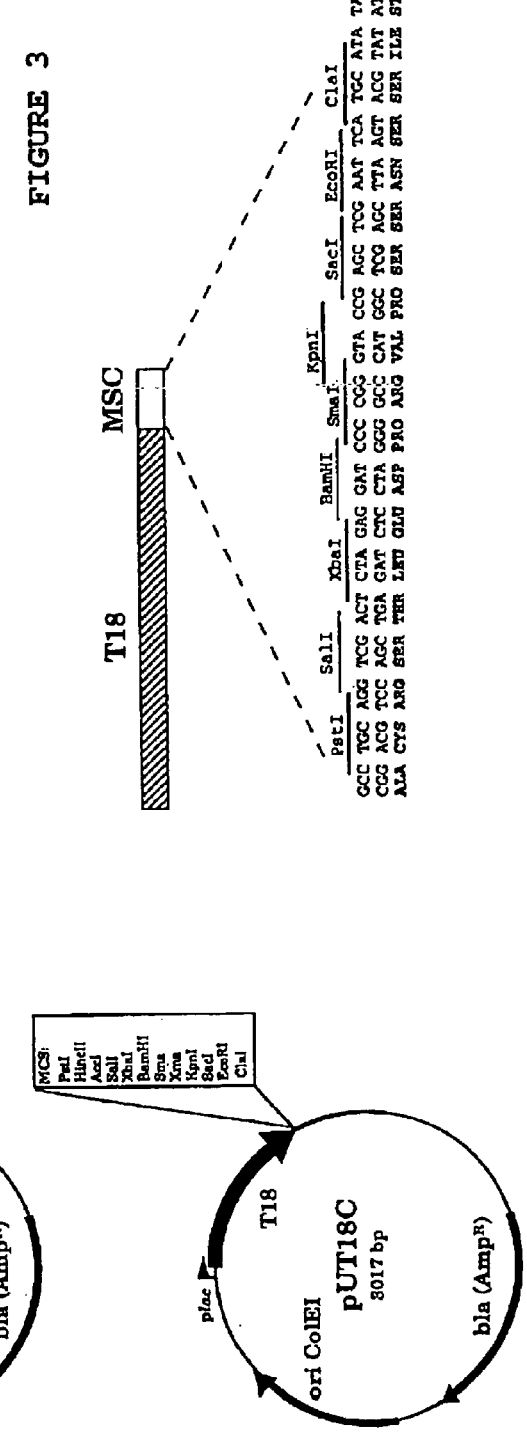
FIGURE 3
FIGURE 4

VECTORS TO CREATE FUSED PROTEINS WITH T25 FRAGMENT

COLLECTION OF PROKARYOTIC DNA FOR TWO HYBRID SYSTEMS HELICOBACTER PYLORI PROTEIN-PROTEIN INTERACTIONS AND APPLICATION THEREOF

CROSS REFERENCE TO RELATED APPLICATIONS

This application is a continuation of International Application No. PCT/IB00/00603, filed Apr. 14, 2000 and published in English. The disclosure of which is incorporated by reference.

FIELD OF THE INVENTION

The present invention concerns new collections of recombinant cell clones derived from a prokaryotic genome, more particularly from *Helicobacter pylori* genome, usable for two-hybrid systems and methods to produce such collections. The invention further relates to the identification of *H. pylori* protein-protein interactions and to the application of said collections of recombinant cell clones and said identified proteins interactions to the pharmaceutical and diagnostic field.

BACKGROUND OF THE INVENTION

Most biological processes involve specific protein-protein interactions. General methodologies to identify interacting proteins or to study these interactions have been developed. The advantages of genetic approaches in drug discovery have recently received increased attention. These advantages include both cost-effectiveness and simplicity.

Among these methods, the yeast two hybrid system currently represents the most powerful in vivo approach to screen for polypeptides that could bind to a given target protein. It is also equally suitable for the detection of both homo- and heterodimeric protein interactions. These technologies have originally been developed by Fields et al. (Fields and Song, 1985, Nature, 340, p. 245–246, "A novel genetic system to detect protein-protein interaction").

The yeast two-hybrid system utilizes hybrid proteins to detect protein-protein interactions by means of direct activation of a reporter-gene expression. In essence, the two putative protein partners are genetically fused to the DNA-binding domain of a transcription factor and to a transcriptional activation domain, respectively. A productive interaction between the two proteins of interest will bring the transcriptional activation domain of an adjacent reporter gene (usually LacZ or a nutritional marker) giving a screenable phenotype. The transcription can be activated through the use of two functional domains of a transcription factor: a domain that recognizes and binds to a specific site on the DNA and a domain that is necessary for activation (Keegan et al., 1986, Science, 231(4739): 699–704 Separation of DNA binding from the transcription activating function of eukaryotic regulatory protein).

To date however, the two-hybrid assay system has not been specifically applied to the systematic study of prokaryotic protein-protein interactions although number of diseases are due to prokaryotic microorganisms.

One of the prokaryotic microorganisms presenting a great interest is *Helicobacter pylori*. *Helicobacter pylori* (*H. pylori*) is a microaerophilic, Gram negative, slow growing, spiral shaped and flagellated organism. *H. pylori* has been first isolated in 1983 from gastric biopsy specimen of patient with chronic gastritis (Marshall et al., 1984, Lancet, i:1311–1314, Unidentified curved bacilli in the stomach of patients with gastritis and peptic ulceration).

*Helicobacter pylori* has become identified as a primary cause of chronic gastroduodenal disorders, such as gastritis, dyspepsia, and peptic ulcers, in humans. Studies have shown (Labigne et al.) that *H. pylori* can be successfully eradicated by a treatment combining two antibiotics with a proton pump inhibitor. However, few antibiotics are active against *H. pylori*, and antibiotic-resistant strains have begun to appear.

*H. pylori* strain n° 26695 genome has been studied by Tomb et al. (Tomb et al., 1997, Nature, vol. 388, 539–547, The complete genome sequence of the gastric pathogen *Helicobacter pylori*). This strain's genome consists of a circular chromosome with a size of 1,667,867 bp, average G+C content of 39%, and 1590 predicted coding sequences (open reading frames or "ORF").

The bacterial factors necessary for colonization of the gastric environment, and for virulence of this pathogen, are poorly understood. Examples of known virulence factors are:

Enzymes involved in neutralizing the acid gastric pH: the multisubunit urease is a characteristic enzyme that is crucial for survival in acidic pH and for successful colonization of the gastric environment, a site that few other microbes can colonize (Labigne et al., WO 93/07273, *Helicobacter pylori* genes necessary for the regulation and maturation of urease, and use thereof). Genes encoding ureases have been located on a 34 kb chromosome fragment and comprise ureA, ureB, ureC, ureD, ureE, ureF, ureG, ureH and ureI.

Bacterial flagellar proteins responsible for motility across the mucous layer (Hazell et al., 1986, J. Inf. Dis., 153, 658–663 *Campylobacter pyloridis* and *gatritis*: association with intracellular spaces and adaptation to an environment of mucus as important factors in colonization of the gastric epithelium; Leying et al., 1992, Mol. Microbiol., 6, 2863–2874 Cloning and genetic characterization of *Helicobacter pylori* flagellin gene): flagellar filaments biosynthesis comprises A and B flagellins and the filament cap. These two biosyntheses are regulated by flbA gene (Suerbaum et al., French patent application, 1995, N 2 736 360, Cloning and characterization of flbA gene of *Helicobacter pylori*, aflagellated strains production).

Two other essential toxins for virulence are VacA and CagA:

VacA is a *H. pylori* toxin that induces the formation of large acidic vacuoles in host epithelial cells. These large vacuoles originate from massive swelling of membranous compartments of late stages of the endocytic pathway (de Bernard et al., 1997, Microbiology, 26(4), 665–674, *Helicobacter pylori* toxin VacA induces vacuole formation by acting in the cell cytosol). Proof for receptor-mediated interaction with VacA has been made by Pagliaccia et al.; m2 allele of vacA gene has always been described as inactive in the in vitro HeLa cell assay, however, the m2 allele is associated with peptic ulcer and is prevalent in populations in which peptic ulcer and gastric cancer have high incidence (Pagliaccia et al., Proc. Natl. Acad. Sci. U.S.A., 1998, 95(17), 10212–10217, The m2 form of the *Helicobacter pylori* cytotoxin has cell type-specific vacuolating activity).

CagA is one of the proteins encoded by the "cag pathogenicity island" (Spohn et al. 1997, Molecular Microbiology, 26(2), 361–372, Transcriptional analysis of the divergent cagAB genes encoded by the pathogenicity island of *Helicobacter pylori*) found in *H. pylori* strains isolated from most patients with peptic ulcer disease and adenocarcinoma. CagA is produced by 50–60% of *H. pylori* strains; it is a high molecular weight (120–140 kDa) superficial protein and an immunodominant antigen with unknown function. *H. pylori* strains that produce CagA protein have two genes cagB and cagC (36 and 101 kDa proteins, respectively). These genes are highly associated with duodenal ulcers (Blaser et al. 1996, WO 96/12825, cagb and cagC genes of *Helicobacter pylori* and related methods and compositions).

Other virulence factors are: several gastric tissue-specific adhesins (Boren et al., 1993, Science, 262, 1892–1895).

Therapeutic agents are currently available that eradicate *H. pylori* infections in vitro. However, methods employing antibiotic agents result in the emergence of bacterial strains which are resistant to these agents.

As number of diseases are due to prokaryotic microorganisms, there is a great need for new tools directed to the functional and global study of these newly characterized complete or partial genome, particurlarly *Escherichia coli* genome, but also of pathogenic microorganisms such as *H. pylori, Staphylococcus aureus* and *Streptococcus pneumoniae* genomes.

In addition to the need for these new tools, there is also and especially a need to find new *E. coli, H. pylori, S. aureus* and *S. pneumoniae* protein-protein interactions for the development of more effective and better targeted therapeutic.

SUMMARY OF THE INVENTION

The present invention relates to a method for producing a collection of recombinant cell clones usable for two-hybrid systems containing genomic DNA fragments of prokaryotic micro-organism, particularly of *E. coli, H. pylori, S. aureus* and *S. pneumoniae*, to collection of recombinant cell clones obtainable by this method and kit for screening comprising said collection.

The invention is also directed to a yeast or bacterial two-hybrid system method for identifying a recombinant cell clone expressing a prey polypeptide of a prokaryotic microorganism capable of interacting with a bait polypeptide and a method for identifying said prey polypeptide.

The present invention further comprises polynucleotides or polypeptides corresponding to the prey polypeptides capable of interacting with a bait polypeptide and the protein-protein interactions identified by the yeast or bacterial two-hybrid system method according to the invention, vectors and host cells containing said polynucleotides, and pharmaceutical composition including them.

The present invention also concerns a method for identifying a polynucleotide encoding a selected interacting domain (SID®) of a prey polypeptide of interest from a prokaryotic microorganism capable of interacting with a bait polypeptide.

Another aspect of the present invention relates to a method for selecting an agent capable of modulating the protein-protein interaction identified by the yeast or bacterial two-hybrid system method according to the invention.

BRIEF DESCRIPTION OF THE DRAWINGS

FIG. 3 is a restriction map of the plasmid pUT18 which may be used for the bacterial two-hybrid system. In this figure, each multicloning site (MCS) is detailled.

FIG. 4 is a restriction map of the plasmid pUT18C which may be used for the bacterial two-hybrid system. In this figure, each multicloning site (MCS) is detailled.

DETAILED DESCRIPTION OF THE INVENTION

Figure 1:
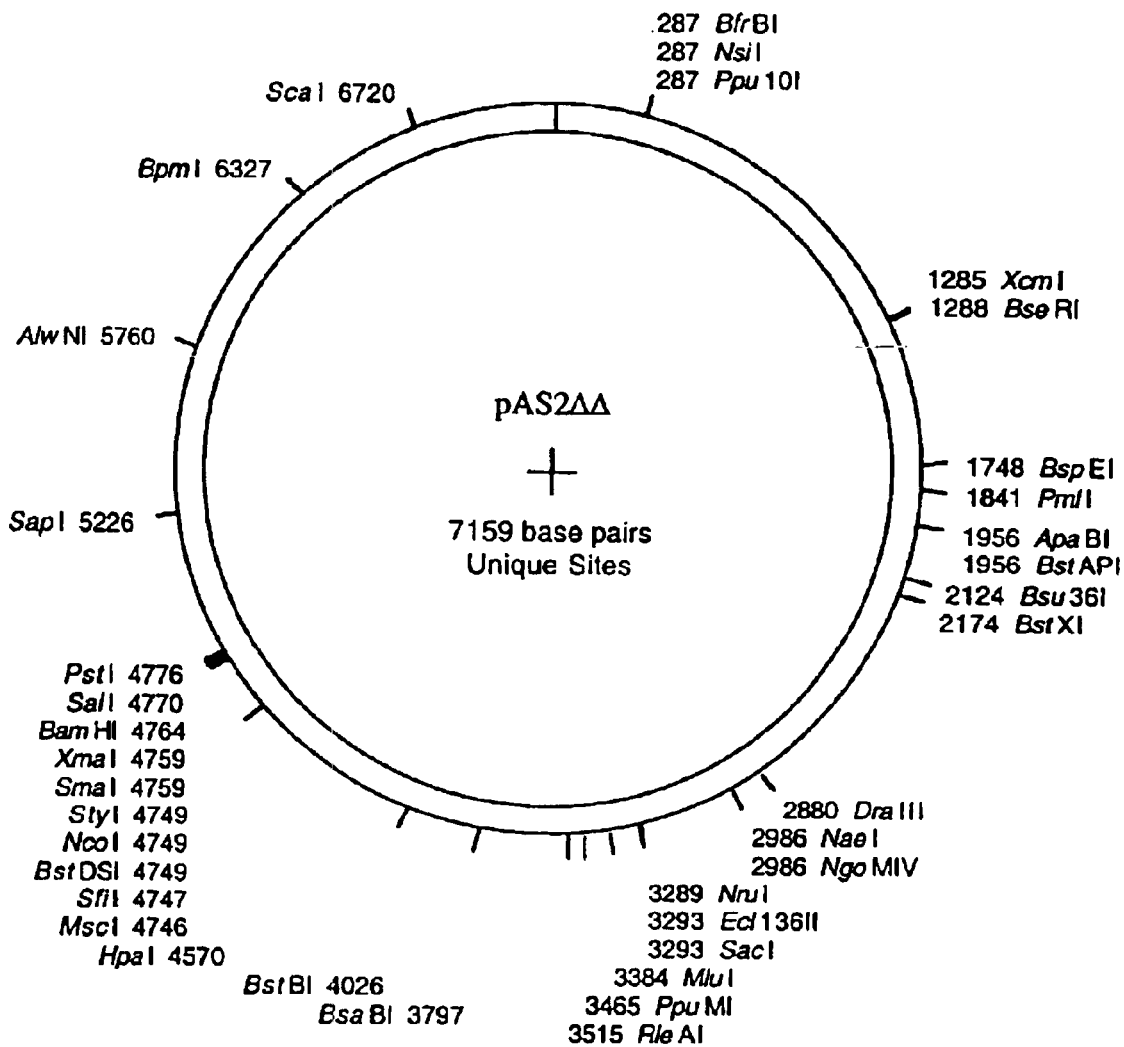
FIG. 1 is a restriction map of the plasmid pAS2ΔΔ which may be used for the yeast two-hybrid system.
Figure 2:
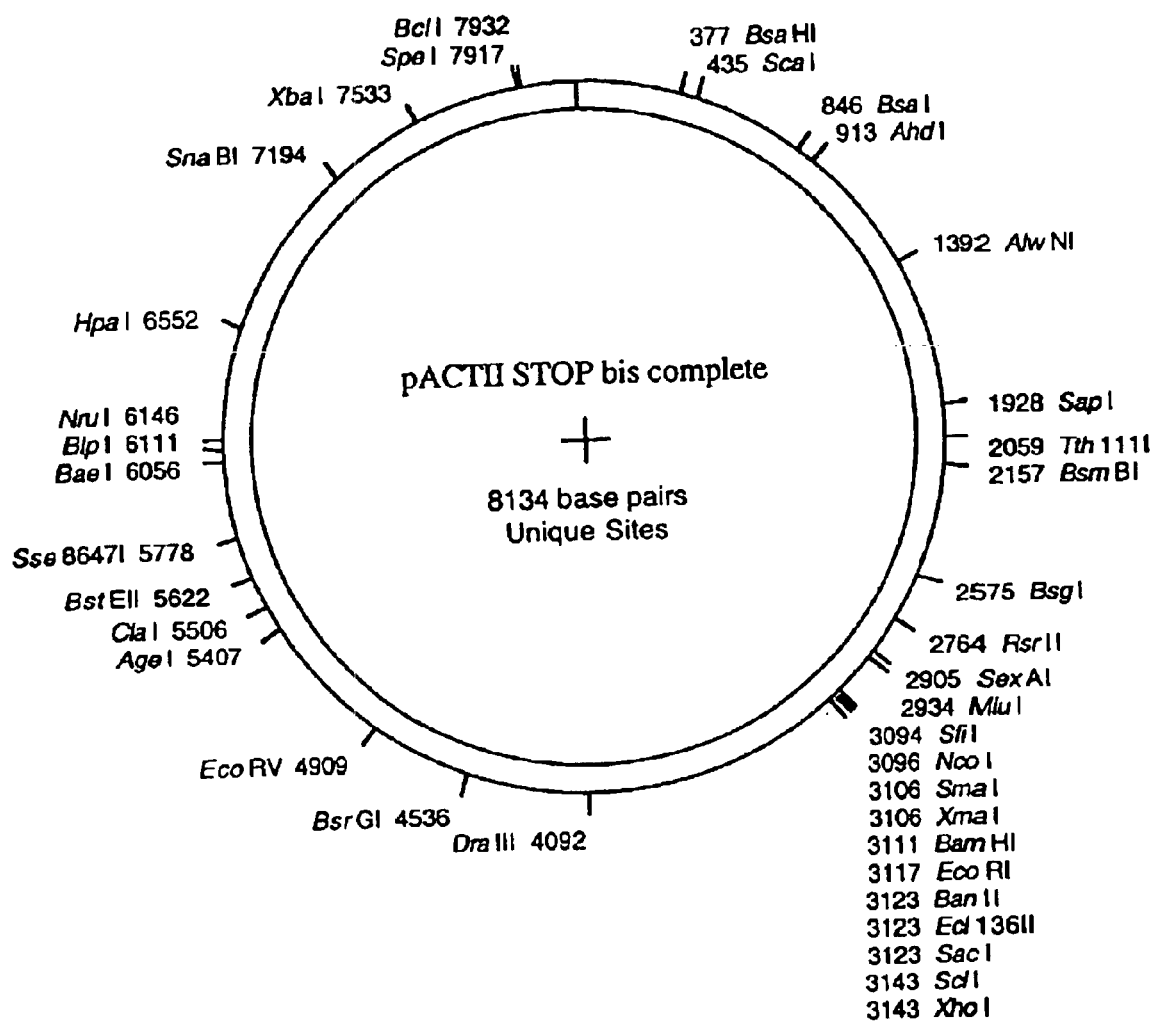
FIG. 2 is a restriction map of the plasmid pACTIIst which may be used for the yeast two-hybrid system.
Figure 5:
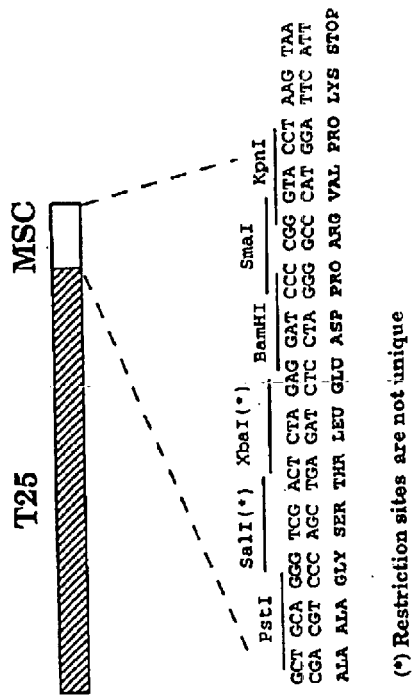
FIG. 5 is a restriction map of the plasmid pT25 which may be used for the bacterial two-hybrid system. In this figure, each multicloning site (MCS) is detailled.
Figure 5:
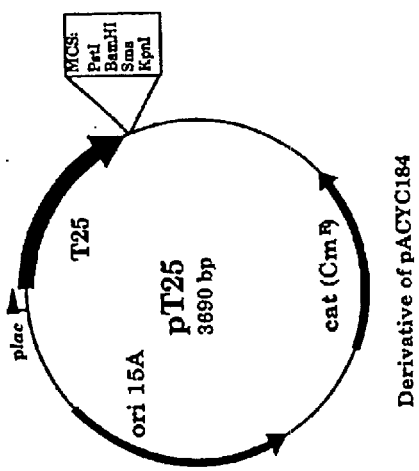
Figure 6:
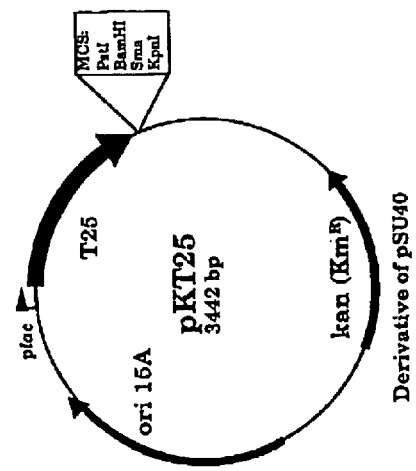
FIG. 6 is a restriction map of the plasmid pKT25 which may be used for the bacterial two-hybrid system. In this figure, each multicloning site (MCS) is detailled.

The present invention is directed to a method for producing a collection of recombinant cell clones usable for two-hybrid systems comprising the steps of:
a) fragmenting DNA;
b) inserting polynucleotidic fragments obtained in step a) in plasmids in such a way that the expression of said plasmids in host cell leads to an hybrid polypeptide containing a specific domain capable of activating a reporter gene when associated with a complementary domain;
c) transforming cell clones with plasmids obtained in step b); and
d) optionally, selecting the transformed recombinant cell clones obtained in step c);
wherein DNA of step a) is genomic DNA obtained from a prokaryotic micro-organism.

The step a) of fragmenting DNA according to the method of the invention may be obtained by enzyme digestion, sonication or nebulization of the source of genomic DNA, sonication and nebulization ensuring a random cleavage of the starting DNA material and thus an excellent representation of all the possible inserts.

In a preferred embodiment, the step a) of fragmenting DNA of the method according to the invention is carried out by a nebulization process, for example, with a commercial nebulizer (GATC).

In a preferred embodiment, the plasmid used in the method for producing a collection of recombinant cell clones usable for two-hybrid systems according to the present invention may comprise in addition a nucleic sequence encoding a promoter, a multicloning site, a terminator site and a selection marker, operably linked.

A "promoter" refers to a DNA sequence recognized by the transcriptional machinery of the cell required to initiate the specific transcription of a gene.

A sequence which is "operably linked" to a regulatory sequence such as a promoter means that said regulatory element is in the correct location and orientation in relation to the nucleic acid to control RNA polymerase initiation and expression of the nucleic acid of interest. As used herein, the term "operably linked" refers to a linkage of polynucleotide elements in a functional relationship. For instance, a promoter or enhancer is operably linked to a coding sequence if it affects the transcription of the coding sequence. More precisely, two DNA molecules (such as a polynucleotide containing a promoter region and a polynucleotide encoding a desired polypeptide or polynucleotide) are said to be "operably linked" if the nature of the linkage between the two polynucleotides does not (1) result in the introduction of a frame-shift mutation or (2) interfere with the ability of the polynucleotide containing the promoter to direct the transcription of the coding polynucleotide.

As a promoter, one could use full or truncated ADH promoter.

By specific domain, it is intended a domain whose association with a complementary domain leads to the activation of a reporter gene.

In one particular embodiment of this invention, the specific domain may be a transcriptional activating domain or a DNA-binding domain and the complementary domain may, respectively, be a DNA binding domain or a transcriptional activation domain.

Transcriptional activating domain and DNA-binding domain may be derived from Gal4 and LexA respectively.

In another particular embodiment of the invention, the activation domain is a part of an enzyme and the complementary domain is the other part of the same enzyme. Proximity of the two parts of the enzyme may restore the enzyme activity and activate a reporter gene.

For example, specific and complementary domain may be T25 and T18 polypeptides that constitute the catalytic domain of *Bordetella pertussis* adenylate cyclase.

The reporter gene may be contained either in a plasmid of recombinant cell clone or in its genome.

As an illustrative embodiment of the invention, the reporter gene is chosen among the group consisting in a nutritional gene or also a gene the expression of which is visualized by colorimetry such as His3, LacZ or both LacZ and His3.

As a selective marker, gene encoding for a toxin, color marker of the type of the Green Fluorescent Protein (GFP), gene encoding for phage receptor proteins or fragment thereof such as phage λ receptor lam B and any other gene giving selectable phenotype, resistance gene, such as ampicilline, kanamycin, tetracyclin or lactose or maltose nutritional gene, may be used.

In a particularly preferred embodiment, the invention relates to a method according to the invention wherein DNA of step a) is genomic DNA obtained from *Helicobacter pylori* (see example 1.A.), *Escherichia coli, Staphylococcus aureus* and *Streptococcus pneumoniae*.

The invention also concerns a collection of recombinant cell clones usable for two-hybrid systems obtainable by a method according to the invention.

The invention further concerns a collection of recombinant cell clones usable for two-hybrid systems, each recombinant cell clone containing a polynucleotide inserted in a plasmid whose expression leads to hybrid polypeptide containing a specific domain, wherein the said polynucleotide is a genomic DNA fragment obtained from a prokaryotic micro-organism.

In a preferred embodiment, said genomic DNA fragment is obtained by a fragmentation process by nebulization.

In a particularly preferred embodiment, the invention relates to collection of recombinant cell clones of the invention wherein the prokaryotic micro-organism is *Helicobacter pylori, Escherichia coli, Staphylococcus aureus* and *Streptococcus pneumoniae*.

The present invention also comprises a collection of recombinant cell clones according to the invention, wherein the recombinant cell clones are selected from the group consisting of Gram+ or Gram− bacteria, yeasts, fungi and mammalian cells, particularly from the group consisting of *Escherichia coli* bacteria and *Saccharomyces cerevisiae* yeast.

The present invention further concerns a collection of recombinant cell clones according to the invention, wherein the plasmids comprise at least a nucleic sequence coding a promoter, a specific domain, a multicloning site where the said polypeptide is cloned, and a selection marker.

In a preferred embodiment, the present invention further concerns a collection of recombinant cell clones according to the invention, wherein the polynucleotide is inserted in the plasmid pACTIIst or in the plasmid pP6.

In a more preferred embodiment, the present invention further concerns a collection of recombinant cell clones according to the invention, wherein the collection contains $10^6$ to $10^7$ or to $10^8$ recombinant *Escherichia coli* clones and wherein the proportion of independent cell clones with insert is at least 60%, 70%, 80%, 90%, 95% or 97%.

The present invention particularly comprises the collection of recombinant cell clones according to the invention which has been deposited in the Collection National de Cultures de Microorganismes (CNCM) (France, Paris) on Apr. 13, 1999 under the accession number I-2181, and on Mar. 23, 2000 under the accession numbers I-2416, I-2414, I-2415 and I-2417.

The collection of recombinant cell clones which has been deposited under the accession number I-2181 (identification reference: HGXBHP1) concerns a genomic library of *Helicobacter pylori* 26695 strain, cloned in the stop bis pACTII vector, transformed in *Escherichia coli* DH10B. The collection contains about $10^7$ independent clones with an insert percentage of about 97% and an insert average size of 1000 pb.

The collection of recombinant cell clones which has been deposited under the accession number I-2416 (identification reference: HGXBSA1) concerns a genomic library of *Staphylococcus aureus* col strain, cloned in the pP6 vector, transformed in *Escherichia coli* DH10B. The collection contains about $6.8 \: 10^7$ independent clones with an insert pourcentage superior to 95% and an insert average size of 1100 pb.

The collection of recombinant cell clones which has been deposited under the accession number I-2415 (identification reference: HGXBEC1) concerns a genomic library of *Escherichia coli* MG1655 strain, cloned in the pP6 vector, transformed in *Escherichia coli* DH10B. The collection contains about $3 \: 10^7$ independent clones with an insert pourcentage superior to 98% and an insert average size of 853 pb.

The collection of recombinant cell clones which has been deposited under the accession number I-2417 (identification-reference: HGXBHP4) concerns a genomic library of *Helicobacter pylori* 26695 strain, cloned in the pP6 vector, transformed in *Escherichia coli* DH10B. The collection contains about $1.9 \: 10^7$ independent clones with an insert pourcentage superior to 98% and an insert average size of 1009 pb.

In another aspect, the present invention relates to a collection of recombinant cell clones according to the invention, wherein the collection contains $10^5$ to $1.5 \times 10^7$ haploid recombinant *Saccharomyces cerevisiae* clones and wherein the proportion of independant cell clones with insert is at least 60%, 70%, 80%, 90%, 95% or 97%.

The present invention particularly comprises the collection of recombinant cell clones according to the invention which has been deposited in the Collection National de Cultures de Microorganismes (CNCM) on Apr. 13, 1999 under the accession number I-2182, and on Mar. 23, 2000 under the accession numbers I-2420, I-2419 and I-2418.

The collection of recombinant cell clones which has been deposited under the accession number I-2182 (identification reference: HGXYHP1) concerns a genomic library of *Helicobacter pylori*, 26195 strain, which has been amplified in *E. coli* (HGXBHP1 librairy), cloned in the stop bis pACTII vector, transformed in *Saccharomyces cerevisiae*, Y187 strain, and containing about $2 \cdot 10^6$ independent clones.

The collection of recombinant cell clones which has been deposited under the accession number I-2420 (identification reference: Lib Sa2) concerns a genomic library of *Staphylococcus aureus*, col strain, which has been amplified in *E. coli* (HGXBSA1 librairy), cloned in the pP6 vector, transformed in *Saccharomyces cerevisiae*, Y187 strain, containing about $2.2 \cdot 10^6$ independent clones, and a cell concentration about $5 \cdot 10^8$ cells/ml.

The collection of recombinant cell clones which has been deposited under the accession number I-2419 (identification reference: Sp in Y187 pP6) concerns a genomic library of *Streptococcus pneumoniae*, type 4 strain, which has been amplified in *E. coli* (HGXBSP 1 librairy), cloned in the pP6 vector, transformed in *Saccharomyces cerevisiae*, Y187 strain, containing about $2.8 \cdot 10^6$ independent clones, and a cell concentration about $5 \cdot 10^8$ cells/ml.

The collection of recombinant cell clones which has been deposited under the accession number I-2418 (identification reference: *E. coli* in Y187 lib1) concerns a genomic library of *Escherichia coli*, MG1655 strain, which has been amplified in *E. coli* (HGXBEC1 librairy), cloned in the pP6 vector, transformed in *Saccharomyces cerevisiae*, Y187 strain, containing about $4 \cdot 10^6$ independent clones, and a cell concentration about $5 \cdot 10^8$ cells/ml.

In another aspect, the present invention relates to a collection of recombinant cell clones according to the invention, wherein the polynucleotide is inserted in the plasmid pAS2ΔΔ.

Still another aspect, the present invention relates to a collection of recombinant cell clones according to the invention, wherein the polynucleotide is inserted in a plasmid selected from the group consisting of pT25, pKT25, pUT18 and pUT18C.

The present invention also relates to a kit for screening protein-protein interaction comprising a collection of recombinant cell clones usable for two-hybrid systems according to the invention.

In a particular embodiment of the collection according to the invention, the DNA library is presented as a ready to use kit for screening protein-protein interaction consisting in a collection of recombinant haploid yeast cells containing the whole genome as inserts generated during the construction of the DNA library under the form of prey polynucleotides, said collection of yeast cells being frozen in multiple vial containing an identical biological material.

The present invention also provides a generally method for selecting a polynucleotide of the collection according to the present invention, encoding a prey polypeptide, that is capable of interacting with bait polypeptide of interest.

As used interchangeably herein, the terms "polynucleotides", "nucleic acid" "oligonucleotides", include RNA, DNA, or RNA/DNA hybrid sequences of more than one nucleotide in either single chain or duplex form. The polynucleotide sequences of the invention may be prepared by any known method, including synthetic, recombinant, ex vivo generation, or a combination thereof, as well as utilizing any purification methods known in the art.

The term "purified" is used herein to describe a polynucleotide of the invention which has been separated from other compounds including, but not limited to other nucleic acids, carbohydrates, lipids and proteins. A polynucleotide is substantially pure when at least about 50%, preferably 60 to 90% weight/weight of a sample exhibits a single polynucleotide sequence, more usually about 95%, and preferably is over about 99%.

As used herein, the term "isolated" requires that the material be removed from its original environment (e.g., the natural environment if it is naturally occurring). For example, a naturally-occurring polynucleotide or polypeptide present in a living animal is not isolated, but the same polynucleotide or DNA or polypeptide, separated from some or all of the coexisting materials in the natural system, is isolated. Such polynucleotide could be part of a vector and/or such polynucleotide or polypeptide could be part of a composition, and still be isolated in that the vector or composition is not part of its natural environment.

The term "polypeptide" refers to a polymer of amino acids without regard to the length of the polymer; thus, peptides, oligopeptides, and proteins are included within the definition of polypeptide, theses terms as used herein are interchangeable. The term "polypeptide" also does not specify or exclude post-expression modifications of polypeptides, for example, polypeptides which include the covalent attachment of glycosyl groups, acetyl groups, phosphate groups, lipid groups and the like are expressly encompassed by the term polypeptide. Also included within the definition are polypeptides which contain one or more analogs of an amino acid (including, for example, non-naturally occurring amino acids, amino acids which only occur naturally in an unrelated biological system, modified amino acids from mammalian).

The term "purified" is used herein to describe a polypeptide of the invention which has been separated from other compounds including, but not limited to nucleic acids, carbohydrates, lipids and other proteins. A purified polypeptide typically comprises about 50%, preferably 60 to 90% weight/weight of a protein sample, more usually about 95%, and preferably is over about 99% pure.

Bait polypeptide of interest is either a prokaryotic polypeptide encoded by a polynucleotide of the collection according to the present invention, or any other polypeptides of interest. Other polypeptides of interest can be polypeptides of an organism that may be infected by the prokaryotic micro-organism, for example, mammalian organism, in particular human organism.

The following described method is the mating yeast two-hybrid system and the bacterial two-hybrid system but variants of two-hybrid systems could also be used.

For example, the three hybrid system (Tirode et al., 1997, Journal of Biological Chemistry, 272, 22995–22999, A conditionally expressed third partner stabilises or prevents the formation of a transcriptional activator in a three-hybrid system) involves three polypeptides that allow or prevent the formation of the transcriptional activator. Beside the two-hybrid fusion proteins, the third partner is under the control of the Met25 promoter, which is positively regulated in medium lacking methionine. Another variant is the reverse two-hybrid system (Vidal et al., 1996, Proc. Natl. Sci., 93, 10315–10320, Reverse two-hybrid and one-hybrid system to detect dissociation of protein-protein and DNA-protein interaction) where a collection of molecules can be screened that may inhibit a specific protein-protein interaction.

Yet another aspect, the present invention relates to yeast two-hybrid system method for identifying a recombinant cell clone containing a prey polynucleotide encoding a prey polypeptide capable of interacting with a bait polypeptide comprising the steps of:
a) mating at least one first haploid recombinant cell clone of a collection of recombinant cell clones according to the invention transformed with a plasmid containing the prey polynucleotide to be assayed with a second haploid recombinant *S. cerevisiae* cell clone transformed with a plasmid containing a bait polynucleotide encoding said bait polypeptide;
b) cultivating diploid cell obtained in step a) on selective medium; and
c) selecting recombinant cell clones capable of growing on selective medium.

In a particular embodiment, the invention is directed to a yeast two-hybrid system method for identifying a prey polynucleotide encoding a prey polypeptide capable of interacting with a bait polypeptide comprising the steps of:
a) identifying a recombinant cell clone containing a prey polynucleotide encoding a prey polypeptide capable of interacting with a bait polypeptide according to the invention; and
b) characterizing the prey polynucleotide contained in each recombinant cell clone selected in step a).

By yeast two-hybrid system is intended a method that usually makes use of at least one reporter gene, the transcription of which is activated when a prey polypeptide and a bait polypeptide produced by recombinant cell, due to the triggering of the transcription of said at least one reporter gene when both the specific domain contained in one prey polypeptide and the complementary domain contained in the bait polypeptide are in proximity one to the other. In an advantageous variant of yeast two hybrid system, prey polynucleotides encoding for prey polypeptides and bait polynucleotides encoding for bait polypeptides or proteins are inserted in recombinant haploid yeast cells, then a mating step leads to diploid yeast cells that produce the prey polypeptide and the bait polypeptide.

By at least one reporter gene according to the invention, it is intended from one to five, and preferably two or three reporter genes, the transcription of which is activated within the recombinant diploid yeast cell when the encoded bait and prey polypeptide are capable of interacting.

Preferably, the at least one reporter gene is contained in the first recombinant haploid yeast cell containing the bait polynucleotide.

The at least one reporter gene may be contained either in a plasmid of the recombinant diploid yeast cell or in its genome.

As an illustrative embodiment, the at least one reporter gene is located in the chromosome of one recombinant haploid yeast cell used according to the previously described two-hybrid system and preferably the yeast cell containing the bait polynucleotide. The at least one reporter gene can be chosen among the group consisting in a nutritional gene or also a gene the expression of which is visualized by colorimetry, such as His3, LacZ or both LacZ and His3.

By "prey polynucleotide", it is intended a chimeric polynucleotide encoding a chimeric polypeptide comprising i) a specific domain and ii) a polypeptide that is to be tested for interaction with a bait polypeptide. The specific domain is preferably a transcriptional activating domain.

The prey polynucleotide may be obtained from a genomic library of a prokaryotic micro-organism, preferably from genomic DNA of *Helicobacter pylori*.

By a "bait polynucleotide", it is intended a chimeric polynucleotide encoding a chimeric polypeptide comprising i) a complementary domain and ii) a polypeptide that is to be tested for interaction with at least one prey polypeptide. The complementary domain is preferably a DNA-binding domain that recognizes a binding site on a detectable gene that is contained in a host organism.

Using as the bait polynucleotide, a complete open reading frame (ORF) that may be obtained either by digestion with a restriction endonuclease (Sambrook et al., 1973, Biochemistry 12(16): 3055–63 *Detection of two restriction endonuclease activities in Haemophilus parainfluenzae using analytical agarose-ethidium bromide electrophoresis*) or by digestion with an exonuclease such as Ball, or also by DNA synthesis. The complete ORF can also correspond to a given prey selected at given round with a two-hybrid system. An "open reading frame", also referred to herein as ORF, is a region of nucleic acid which encodes a polypeptide. This region may represent a portion of a coding sequence or a total sequence and be determined from a stop to stop codon or from a start to stop codon.

"DNA-binding domain" refers to a protein that specifically interacts with desoxyribonucleotide strands. A sequence-specific DNA binding protein binds to a specific sequence or family of specific sequences showing a high degree of sequence identity with each other.

The DNA binding domain of the bait polypeptide and the transcriptional activating domain of the prey polypeptide may be of different kinds. As an illustrative embodiment, these can be derived from LexA or also Gal4.

In one particular experiment of the yeast two-hybrid system, prey polypeptides are encoded by prey polynucleotides cloned in plasmid pACTIIst carrying Leu2 selection gene transformed in Y187 yeast cells carrying leucine auxotrophy and bait polypeptide are encoded by bait polynucleotide cloned in plasmid pAS2ΔΔ carrying Trp1 selection gene transformed in CG1945 yeast cells carrying tryptophane auxotrophy.

In another aspect, the present invention relates to a bacterial two-hybrid system method for identifying a recombinant cell clone containing a prey polynucleotide encoding a prey polypeptide capable of interacting with a bait polypeptide comprising the steps of:
a) transforming bacterial cell clones with a plasmid containing a bait polynucleotide encoding said bait polypeptide;
b) rescuing prey plasmids containing prey polynucleotides from the collection according to the present invention;
c) transforming the recombinant bacterial cell clones obtained in step a) with the plasmid rescued in step b);
d) cultivating bacterial recombinant cells obtained in step c) on selective medium;
e) selecting recombinant cell clones capable of growing on selective medium.c) selecting recombinant cell clones capable of growing on selective medium.

In a preferred embodiment, the preparation of bacterial recombinant cells obtained in step c) of the bacterial two-hybrid system method for identifying a recombinant cell clone according to the invention comprises the following steps:
1) *E. coli* is firstly transformed with bait plamid (standard protocol with chimio- or electro-competent cells);
2) prey plasmids are rescued from collection according to the invention (prey plasmids are in *E. coli* bacterial strain, cf. protocol 1.B <<the plasmid DNA contained in *E. coli* are extracted (Qiagen) from aloquoted *E. coli* frozen cells>>);
3) rescued prey plasmids are then transformed in recombinant *E. coli* of step 1 according to standard protocols of transformation (for example using electro- of chimio-competent cells).

In a particular embodiment, the invention is directed to a bacterial two-hybrid system method for identifying a prey polynucleotide encoding a prey polypeptide capable of interacting with a bait polypeptide comprising the steps of:
a) identifying a recombinant cell clone containing a prey polynucleotide encoding a prey polypeptide capable of interacting with a bait polypeptide according to the invention; and
b) characterizing the prey polynucleotide contained in each recombinant cell clone selected in step a).

By bacterial two-hybrid system is intended a method that usually makes use of at least one reporter gene, the transcription of which is activated when a prey polypeptide and a bait polypeptide produced by recombinant cell, due to the triggering of the transcription of said at least one reporter gene when both the specific domain contained in one prey polypeptide and the complementary domain contained in the bait polypeptide are in proximity one to the other.

In a particular embodiment of the bacterial two-hybrid system, specific domain of prey polypeptide and complementary domain of bait polypeptide are part of the catalytic domain of an enzyme. Interaction of prey polypeptide and bait polypeptide allows restoration of enzyme catalytic domain and, as a consequence, to the restoration of the enzyme activity.

In a more preferred embodiment of the bacterial two-hybrid method, enzyme is *Bordetella pertussis* adenylate cyclase which activation, via proximity of T25 and T18 fragments of the catabolic domain, leads to cAMP synthesis, cAMP then triggers transcriptional activation of catabolic operons, such as lactose or maltose.

Still another aspect, the present invention relates to a method according to the invention, wherein the bait polypeptide and the prey polypeptide (encoded by a polynucleotide inserted in cell clone from the collection according to the present invention) are originating from the same prokaryotic micro-organism, particularly from *Helicobacter pylori, Escherichia coli, Staphylococcus aureus* or *Streptococcus pneumoniae* or wherein the bait polypeptide is originating from a human polypeptide and the prey polypeptide is originating from a prokaryotic micro-organism, particularly from *Helicobacter pylori*.

Yet another aspect, the present invention relates to a recombinant diploid yeast cell obtained by step a) of the yeast two-hybrid system method for identifying a recombinant cell clone according to the invention as described above.

The recombinant diploid yeast cell obtained by the the yeast two-hybrid system method for identifying a recombinant cell clone according to the invention, also forms part of the present invention.

By performing yeast or bacterial two-hybrid system, it can be possible to identify for one particular bait interacting prey polypeptide. Prey polynucleotide that has been selected by testing the collection in a screening two-hybrid method encodes for polypeptide interacting with a protein of interest.

The running of the two-hybrid method leads to the identification of interactions between prokaryotic-prokaryotic polypeptides, especially *Helicobacter pylori, Escherichia coli, Staphylococcus aureus* or *Streptococcus pneumoniae* polypeptides, or eukaryotic-prokaryotic polypeptides, these interactions are also part of the invention.

In another aspect, the present invention is directed to a polynucleotide, or fragment thereof, encoding a prey polypeptide capable of interacting with a bait polypeptide wherein said polynucleotide is identified by a method according to the invention.

In a preferred embodiment, the invention comprises the polynucleotides according to the invention, selected from the group consisting of:
a) a polynucleotide having the nucleic acid sequence of an ORF identified by the reference indicated in the right column "interacting ORF" in table I, and fragment thereof having at least 12 consecutive nucleotides;
b) a polynucleotide having at least 80%, preferably at least 85%, 90%, 95% and 99%, nucleotides identity degree after alignment to a nucleic acid sequence of a polynucleotide of a);
c) a polynucleotide comprising the nucleic acid sequence of a polynucleotide of a) or b).

Still another aspect, the present invention is directed to a polynucleotide, or fragment thereof, encoding a bait polypeptide capable of interacting with a prey polypeptide wherein the polynucleotide encoding said prey polypeptide is identified by a method according to the invention.

In a preferred embodiment, the invention comprises the polynucleotides according to the invention, selected from the group consisting of:
a) a polynucleotide having the nucleic acid sequence of an ORF identified by the reference indicated in the left column "bait polypeptide" in table I, and fragment thereof having at least 12 consecutive nucleotides;
b) a polynucleotide having at least 80%, preferably at least 85%, 90%, 95% and 99%, identity degree after alignment to a nucleic acid sequence of a polynucleotide of a);
c) a polynucleotide comprising the nucleic acid sequence of a polynucleotide of a) or b).

Yet another aspect, the present invention relates to a set of two polynucleotides consisting of a first polynucleotide, or fragment thereof, encoding a prey polypeptide capable of interacting with a bait polypeptide according to the invention and a second polynucleotide, or a fragment thereof having at least 12 consecutive nucleotides, encoding said bait polypeptide.

The polypeptides encoded by the polynucleotides according to the invention and the sets of two polypeptides encoded by the sets of two polynucleotides according to the invention, also form part of the invention.

In a preferred embodiment, the invention concerns an isolated complex comprising at least the two polypeptides encoded by a set of two polynucleotides according to the invention, preferably said two polypeptides are associated in the complex by affinity binding.

In a preferred embodiment, the invention concerns an isolated complex comprising at least a polypeptide encoded by the ORF HP1198 (or a fragment thereof, preferably one of its SID® domains, or homologuous polypeptide thereof exhibiting at least 80% identity degree) and a polypeptide encoded by the ORF HP1293 (or a fragment thereof, preferably one of its SID® domains, or homologuous polypeptide thereof exhibiting at least 80% identity degree).

In a preferred embodiment, the invention concerns an isolated complex comprising at least a polypeptide encoded by the ORF HP1198 (or a fragment thereof, preferably one of its SID® domains, or homologuous polypeptide thereof exhibiting at least 80% identity degree) and a polypeptide encoded by the ORF HP0088 (or a fragment thereof, preferably one of its SID® domains, or homologuous polypeptide thereof exhibiting at least 80% identity degree).

In a preferred embodiment, the invention concerns an isolated complex comprising at least a polypeptide encoded by the ORF HP1198 (or a fragment thereof, preferably one of its SID® domains, or homologous polypeptide thereof exhibiting at least 80% identity degree) and a polypeptide encoded by the ORF HP1032 (or a fragment thereof, preferably one of its SID® domains, or homoguous polypeptide thereof exhibiting at least 80% identity degree).

In another aspect, the present invention relates to a protein-protein interaction wherein the two interacting proteins consist of a set of two polypeptides according to the invention.

In a preferred embodiment, the invention relates to the protein-protein interactions according to the invention, wherein the sets of two polypeptides consist of two *Helicobacter pylori, Escherichia coli, Staphylococcus aureus* or *Streptococcus pneumoniae* polypeptides.

When several reiterations of the two-hybrid method are performed and thus common bait and prey polypeptide are selected, a map of all the interactions between these polypeptides may be designed, that take into account of the known and/or suspected biological function of each of the interacting polypeptides.

Such an Proteins Interaction Map (PIM®) may help the one skilled in the art to decipher a whole metabolical and/or physiological pathway that is functionally active within the host organism from which the initial DNA library is derived. Protein Interaction Map and computable version of PIM® are part of the present invention.

Therefore still another aspect, the present invention is directed to a computable readable medium (such as floppy disk, diskette, CD-rom, and all electronic or magnetic format which can be read by a computer) having stored thereon protein-protein interactions according to the invention, preferably stored in a form of a protein interaction map, as showed, for example, in Fromont-Racine et al., Nature Genetics, 1997, Letter, 277–281, FIG. 3, page 279.

In a preferred embodiment, the invention comprises a computable readable medium according to the invention, wherein the protein-protein interactions stored thereon are linked to annotated database, for example through Internet.

In an other preferred embodiment, the invention comprises a data bank containing the protein-protein interactions stored thereon, said databank being available on a World-Wide Web site, said databank may be annoted by means of others databank.

As the source genomic DNA is randomly fragmented before being inserted in recombinant vectors, several prey polypeptides may be selected for one bait polypeptide. Therefore it is possible to define the Selected Interacting Domain (SID®) which contains the precise polypeptide domain involved in the interaction between the prey polypeptide and the bait polypeptide.

So, in another aspect, the invention relates to a method for identifying a polynucleotide encoding a selected interacting domain (SID®) of a prey polypeptide of interest from a prokaryotic micro-organism capable of interacting with a bait polypeptide comprising the steps of:
a) selecting from prey polynucleotides identifying by a method according to the invention all prey polynucleotides encoding a polypeptide capable of interacting with said bait polypeptide and containing a nucleic acid fragment identical to a nucleic fragment of the polynucleotide encoding the prey polypeptide of interest;
b) determining the polynucleotide common to said all prey polynucleotides selected in step a); and
c) identifying the polynucleotide determining in step b) as being the polynucleotide encoding the selected interacting domain (SID®) of said prey polypeptide of interest.

The polynucleotides encoding a selected interacting domain (SID®) of a prey polypeptide of interest from a prokaryotic micro-organism capable of interacting with a bait polypeptide obtainable by this method, also form part of the invention.

In a particular embodiment, the prey polypeptide of interest is originating from *Helicobacter pylori, Escherichia coli, Staphylococcus aureus* or *Streptococcus pneumoniae*.

In a preferred embodiment, the polynucleotides encoding a selected interacting domain (SID®) of a prey polypeptide of interest according to the invention are selected from the group consisting of:
a) a polynucleotide encoding an amino acids sequence identified by the reference indicated in the right column "SID®" in table II;
b) a polynucleotide having the sequence identified by the reference indicated in the right column "SID" in table III;
c) fragment having at least 12, 15, 25 or 50 consecutive nucleotides of polynucleotide of a) or b), complement thereof, and RNA corresponding to said polynucleotide; and
d) a polynucleotide having at least 80%, preferably 85%, 90%, 95% and 99%, identity degree after alignment to a nucleic acid sequence of a polynucleotide of a) or b).

The term "complement thereof" are used herein to refer to the sequences of polynucleotides which is capable of forming Watson & Crick base pairing with another specified polynucleotide throughout the entirety of the complementary region. This term is applied to pairs of polynucleotides based solely upon their sequences and not any particular set of conditions under which the two polynucleotides would actually bind.

The term "degree of sequence identity" is used herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Homology is evaluated using any of the variety of sequence comparison algorithms and programs known in the art. Such algorithms and programs include, but are by no means limited to BLASTN, BLASTP (Altschul et al., 1990, J. Mol. Biol. 215(3): 403–410/Altschul et al., 1993, Nature Genetics 3:266–272/Altschul et al., 1997, Nuc. Acids Res. 25:3389–3402).

The definition of sequence identity given above is the definition that would use one of skill in the art. The definition by itself does not need the help of any algorithm, said algorithms being helpful only to achieve the optimal alignments of sequences, rather than the calculation of sequence identity.

From the definition given above, it follows that there is a well defined and only one value for the sequence identity between two compared sequences which value corresponds to the value obtained for the best or optimal alignment.

In the BLAST N or BLAST P "BLAST 2 sequence" (Tatusova et al., *Blast 2 sequences—a new tool for comparing protein and nucleotide sequences*, FEMS Microbiol.

Lett. 174:247–250) software which is available in the web site http://www.ncbi.nlm.nih.gov/gorf/b12.html, and habitually used by the inventors and in general by the skilled man for comparing and determining the identity between two sequences, the "open gap penaltie" and <<extension gap penaltie>> parameters which depend on the substitution matrix selected regarding the nature and the length of the sequence to be compared are directly selected by the software (i.e. "5" and "2" respectively for substitution matrix BLOSUM-62). The identity percentage between the two sequences to be compared is directly calculated by the software.

In another object, the invention also comprises the polypeptides selected from the group consisting of:
a) a polypeptide having an amino acids sequence identified by the reference indicated in the right column "SID®" in table II, and fragment thereof having at least 5 consecutive amino acids; and
b) a polypeptide encoded by a polynucleotide encoding a selected interacting domain (SID®) of a prey polypeptide of interest according to the invention.

Still another aspect, the invention relates to the use of a polynucleotide according to the present invention as a primer or a probe for the amplification and/or the detection of polynucleotide encoded a prey polypeptide of interest, or its SID®, capable of interacting with a bait polypeptide according to the present invention.

In another aspect, the present invention concerns cloning or expression vector containing a polynucleotide according to the invention.

Particularly preferred vectors of the invention include the plasmid pACTIIst, pAS2ΔΔ, pP6 or the plasmid selected from the group consisting of pT25, pKT25, pUT18 and pUT18C.

Further preferred vectors are self replicated or viral vectors, such as adenovirus, AAV, a retrovirus, a poxvirus or an herpes virus.

The vectors according to the invention, characterized in that they comprise the elements allowing the expression and/or the secretion of the said sequences in a host cell, also form part of the invention.

Vector according to the invention including elements allowing expression and/or secretion of said polynucleotide in a host cell also form part of the invention.

The vectors according to the invention characterized in that they comprise a promoter and/or regulator sequence, or a sequence for cellular addressing according to the invention, or one of their fragments, are also included in the invention.

The said vectors will preferably comprise a promoter, signals for initiation and termination of translation, as well as appropriate regions for regulation of transcription. They may also be capable of being stably maintained in the cell and may optionally possess particular signals specifying the secretion of the translated protein.

These different control signals are chosen according to the cellular host used. To this end, the nucleic acid sequences according to the invention may be inserted into autonomously replicating vectors inside the chosen host, or integrative vectors of the chosen host.

Among the autonomously or self replicating systems, there will be preferably used according to the host cell, systems of the plasmid or viral type, it being possible for the viral vectors to be in particular adenoviruses (Perricaudet et al., 1992, La Recherche 23:471–473, 1992), retroviruses, poxviruses or herpes viruses (Epstein et al., 1992, Médecine/Sciences 8:902–911, 1992). Persons skilled in the art know the technologies which can be used for each of these systems.

When the integration of the sequence into the chromosomes of the host cell is desired, it will be possible to use, for example, systems of the plasmid or viral type; such viruses will be, for example, retroviruses (Temin, 1986, In Kucherlapati R., ed. Gene Transfer, New York, Plenum Press, 149–187, 1986), or AAVs (Carter, 1993, *Curr. Op. Biotechnology* 3:533–539, 1993).

Such vectors will be prepared according to the methods commonly used by persons skilled in the art, and the clones resulting therefrom may be introduced into an appropriate host by standard methods such as, for example, lipofection, electroporation or heat shock.

The invention comprises, in addition, the host cells, in particular eukaryotic and prokaryotic cells, transformed by the vectors according to the invention.

Among the cells which can be used for these purposes, there may of course be mentioned bacterial cells (Olins et al., Curr. Op. Biotechnology 4:520–525, 1993), but also yeast cells (Buckholz, Curr. Op. Biotechnology 4:538–542, 1993), as well as animal cells, in particular mammalian cell cultures (Edwards and Aruffo, Curr. Op. Biotechnology 4:558–563, 1993), and in particular Chinese hamster ovary cells (CHO), but also insect cells in which it is possible to use methods using baculoviruses, for example (Luckow et al., Curr. Op. Biotechnology 4:564–572, 1993). A preferred cellular host for the expression of the proteins of the invention consists of the CHO cells.

The cells according to the invention can be used in a method for the production of a polypeptide according to the invention, as described below, and can also serve as a model for analysis and screening.

So, the present invention comprises a method for producing a polypeptide of the invention comprising the steps of:
a) cultivating a host cell according to the invention under conditions and in culture medium allowing the growth of said host cell and the expression of said polypeptide; and
b) recovering said polypeptide directly from the culture medium or from said cultivated cell obtained in step a).

Recombinant polypeptide obtained by the method above also form part of the invention.

The term "recombinant polypeptide" is used herein to refer to polypeptides that have been artificially designed and which comprise at least two polypeptide sequences that are not found as contiguous polypeptide sequences in their initial natural environment, or to refer to polypeptides which have been expressed from a recombinant polynucleotide.

The method for the production of a polypeptide of the invention in recombinant form is itself included in the present invention, and is characterized in that the transformed cells, are cultured under conditions allowing the expression of a recombinant polypeptide encoded by a polynucleotide according to the invention, and in that the said recombinant polypeptide is recovered.

Also forming part of the invention is a method for the production of a heterologous polypeptide, characterized in that it uses a vector or a host cell according to the invention.

The recombinant polypeptides, characterized in that they are obtainable by the said method of production, also form part of the invention.

The recombinant polypeptides obtained as indicated above may be both in glycosylated and non-glycosylated form and may or may not have the natural tertiary structure.

These polypeptides may be produced from the polynucleotide, according to techniques for the production of recombinant polypeptides known to persons skilled in the art. In this case, the polynucleotide used is placed under the control of signals allowing its expression in a cellular host.

An effective system of production of a recombinant polypeptide requires having a vector and a host cell according to the invention.

These cells may be obtained by introducing into the host cells a nucleotide sequence inserted into a vector as defined above, and then culturing the said cells under conditions allowing the replication and/or expression of the transfected nucleotide sequence.

The methods for the purification of a recombinant polypeptide which are used are known to persons skilled in the art. The recombinant polypeptide may be purified from cell lysates and extracts, from the culture medium supernatant, by methods used individually or in combination, such as fractionation, chromatographic methods, immunoaffinity techniques with the aid of specific mono- or polyclonal antibodies, and the like.

A preferred variant consists in producing a recombinant polypeptide fused with a "carrier" protein (chimeric protein). The advantage of this system is that it allows a stabilization and a reduction in proteolysis of the recombinant product, an increase in solubility during in vitro renaturation and/or simplification of the purification when the fusion partner has affinity for a specific ligand.

The invention also relates to the synthesis of synthetic polypeptides of the invention, in particular by chemical synthesis.

The polypeptides according to the present invention can be obtained by chemical synthesis using any of the numerous known peptide syntheses, for example the techniques using solid phases or techniques using partial solid phases, by condensation of fragments or by a conventional synthesis in solution.

Also forming part of the invention are the methods for the determination of the presence of a polynucleotide or a polypeptide encoded by involved in an protein-protein interaction of the present invention, characterized in that they use a polynucleotide or an antibody according to the invention.

These methods relate to, for example, the methods for the diagnosis in vitro of the presence in a biological sample of the procaryotic micro-organism from which said polypeptide is originating. The polynucleotide analysed may be either the genomic DNA, the cDNA or the mRNA.

These methods can use the probes and primers of the present invention.

The term "primer" denotes a specific oligonucleotide sequence which is complementary to a target nucleotide sequence and used to hybridize to the target nucleotide sequence. A primer serves as an initiation point for nucleotide polymerization catalyzed by either DNA polymerase, RNA polymerase or reverse transcriptase.

The term "probe" denotes a defined nucleic acid segment (or nucleotide analog segment, e.g., polynucleotide as defined hereinbelow) which can be used to identify a specific polynucleotide sequence present in samples, said nucleic acid segment comprising a nucleotide sequence complementary of the specific polynucleotide sequence to be identified.

They are generally purified nucleic sequences for hybridization comprising at least 12 nucleotides, preferably at least 15, 20 and 25 nucleotides, characterized in that they can hybridize specifically with the polynucleotide chosen encoding the polypeptide of interest involved in an protein-protein interaction of the present invention.

Among the methods for the determination of the presence of a polynucleotide encoding a polypeptide of interest involved in an protein-protein interaction of the present invention, the methods comprising at least one stage for the so-called PCR (polymerase chain reaction) or PCR-like amplification of the target polynucleotide according to the invention with the aid of a pair of primers of nucleotide sequences according to the invention are preferred.

PCR-like will be understood to mean all methods using direct or indirect reproductions of nucleic acid sequences, or alternatively in which the labelling systems have been amplified, these techniques are of course known, in general they involve the amplification of DNA by a polymerase; when the original sample is an RNA, it is advisable to carry out a reverse transcription beforehand. There are currently a great number of methods allowing this amplification, for example the so-called NASBA "Nucleic Acid Sequence Based Amplification" (Compton J. 1991 Nature. 350 (6313): 91–92), TAS "Transcription based Amplification System" (Guatelli et al., 1990, Proc. Natl. Acad. Sci. USA. 35:273–286), LCR "Ligase Chain Reaction" (Landegren et al., 1998, Genome Research, 8:769–776), "Endo Run Amplification" (ERA), "Cycling Probe Reaction" (CPR), and SDA "Strand Displacement Amplification" (Walker et al., Nucleic Acids Res. 20:1691–1696, 1992), methods well known to persons skilled in the art.

The invention comprises, in addition, methods for the determination of the presence of a polypeptide of interest involved in an protein-protein interaction of the present invention, characterized in that an antibody according to the invention is brought into contact with the biological material to be tested, under conditions allowing the possible formation of specific immunological complexes between the said polypeptide and the said antibody, and in that the immunological complexes possibly formed are detected, such as, for example, methods using RIA or ELISA.

The transformed cells as described above can also be used as models so as to study the interactions between a polypeptide of the invention and their interacting partners polypeptide, or between a polypeptide of the invention and chemical or protein compounds which are capable of modulating the protein-protein interaction according to the invention wherein said polypeptide of the invention is involved.

In particular, they may be used for the selection of products which interact with a polypeptide of the invention, or one of its SID® domains, as cofactor or as inhibitor, in particular a competitive inhibitor, or alternatively having an agonist or antagonist activity on the protein-protein interaction wherein said polypeptide of the invention is involved. Preferably, the said transformed cells will be used as a model allowing, in particular, the selection of products which make it possible to prevent and/or to treat pathologies induced by prokaryotic micro-organism.

Still another aspect of the invention pertains to a method for selecting an agent or compound capable of modulating the protein-protein interaction of a set of two polypeptides according to the invention comprising the steps of:

a) cultivating a recombinant cell clone containing a reporter gene expression of which is toxic for said recombinant cell clone and transformed with two plasmids wherein:
  i) the first plasmid contains a nucleic construct comprising a nucleic sequence encoding a first hybrid polypeptide containing one of said two polypeptides and a DNA binding domain;
  ii) the second plasmid contains a nucleic construct comprising a nucleic sequence encoding-a second hybrid -polypeptide containing the second of said two polypeptides and an activating domain capable of activating said toxic reporter gene when the first and the second hybrid polypeptides are interacting;
on a selective medium containing the agent to be tested and allowing the growth of said recombinant cell clone when the toxic reporter gene is not activated; and b) selecting agent which is capable of inhibiting the growth of the recombinant cell clone cultivated in step a).

The invention also comprises a method for selecting an agent or compound capable of modulating the protein-protein interaction of a set of two polypeptides according to the invention comprising the steps of:
a) cultivating a recombinant cell clone, preferably permeable, containing a reporter gene expression of which is toxic for said recombinant cell clone and transformed with two plasmids wherein:
   i) the first plasmid contains a nucleic construct comprising a nucleic sequence encoding a first hybrid polypeptide containing one of said two polypeptides and the first domain of an enzyme;
   ii) the second plasmid contains a nucleic construct comprising a nucleic sequence encoding a second hybrid polypeptide containing the second of said two polypeptides and the second part of said enzyme capable of activating said toxic reporter gene when the first and the second hybrid polypeptides are interacting, said interaction restoring the activity of the enzyme;
on a selective medium containing the agent to be tested and allowing the growth of said recombinant cell clone when the toxic reporter gene is not activated; and
b) selecting agent which is capable of inhibiting the growth of the recombinant cell clone cultivated in step a).

In a preferred embodiment, said toxic reporter gene that can be used for negative selection, is URA3, CYH1 or CYH2 gene.

Still another aspect of the invention pertains to a method for selecting an agent or compound capable of modulating the protein-protein interaction of a set of two polypeptides according to the invention comprising the steps of:
a) cultivating a recombinant cell clone containing a reporter gene expression of which stimulates the growth of said recombinant cell clone and transformed with two plasmids wherein:
   i) the first plasmid contains a nucleic construct comprising a nucleic sequence encoding a first hybrid polypeptide containing one of said two polypeptides and a DNA binding domain;
   ii) the second plasmid contains a nucleic construct comprising a nucleic sequence encoding a second hybrid polypeptide containing the second of said two polypeptides and an activating domain capable of activating said stimulating reporter gene when the first and the second hybrid polypeptides are interacting;
on a selective medium containing the agent to be tested and allowing the normal growth of said recombinant cell clone when the stimulating reporter gene is not activated; and
b) selecting agent which is capable of stimulating the growth of the recombinant cell clone cultivated in step a).

In a preferred embodiment, the method according to the invention for selecting an agent or compound capable of modulating the protein-protein interaction of a set of two polypeptides is a method for selecting an agent capable of modulating the interaction between a polypeptide encoded by the ORF HP1198 (or a fragment thereof, preferably one of its SID® domains, or homologuous polypeptide thereof exhibiting at least 80% identity degree) and a polypeptide encoded by the ORF HP1293 (or a fragment thereof, preferably one of its SID® domains, or homologuous polypeptide thereof exhibiting at least 80% identity degree).

In a preferred embodiment, the method according to the invention for selecting an agent or compound capable of modulating the protein-protein interaction of a set of two polypeptides is a method for selecting an agent capable of modulating the interaction between a polypeptide encoded by the ORF HP1198 (or a fragment thereof, preferably one of its SID® domains, or homologuous polypeptide thereof exhibiting at least 80% identity degree) and a polypeptide encoded by the ORF HP0088 (or a fragment thereof, preferably one of its SID® domains, or homologuous polypeptide thereof exhibiting at least 80% identity degree).

In a preferred embodiment, the method according to the invention for selecting an agent or compound capable of modulating the protein-protein interaction of a set of two polypeptides is a method for selecting an agent capable of modulating the interaction between a polypeptide encoded by the ORF HP1198 (or a fragment thereof, preferably one of its SID® domains, or homologuous polypeptide thereof exhibiting at least 80% identity degree) and a polypeptide encoded by the ORF HP1032 (or a fragment thereof, preferably one of its SID® domains, or homologuous polypeptide thereof exhibiting at least 80% identity degree).

In another embodiment of the invention, inventors provide a kit for screening a modulator agent comprising at least one recombinant diploid clone or a cell clone, haploid or diploid, transformed with a plasmid containing a sequence coding for a bait polypeptide and a plasmid containing the nucleotide sequence of a SID® or of homologue polypeptide of SID®, said plasmids may be chosen between pACTIIst and pAS2ΔΔ.

SID® or homologue sequence of SID® acting on the same pair of interacting proteins may be also modulator agents.

Modulator agent selected by anyone of the yeast or bacterial two-hybrid system method of the invention also forms part of the invention.

These modulator agents of protein-protein interaction according to the invention may be obtained for example from a library of compounds.

Consequently, is also part of the invention a modulator agent selected by the method of the invention previously described capable of interfering with a protein-protein interaction according to the invention. This agent may modulate an interaction of the invention between two prokaryotic polypeptides, particularly between two *Helicobacter pylori, Escherichia coli, Staphylococcus aureus* or *Streptococcus pneumoniae* polypeptides, or between a prokaryotic polypeptide, such as *Helicobacter pylori, Staphylococcus aureus* or *Streptococcus pneumoniae* polypeptide, and a polypeptide originating from a host organism of said prokaryotic micro-organism, such as mammal, particularly human.

These methods allow the selection of chemical or biochemical compound capable of interacting, directly or indirectly, with the polynucleotide or the polypeptide encoded by of the invention, in particular capable of modulating the protein-protein interaction wherein said polypeptide of the invention is involved.

More particularly, the invention concerns modulator agent capable of modulating, more preferred of inhibiting, the viability and/or the growth of the prokaryotic micro-organism, preferably *Helicobacter pylori, Staphylococcus aureus* or *Streptococcus pneumoniae*, from which is the protein-protein interaction.

For the screening of compounds capable of modulating the protein-protein interaction wherein said polypeptide of the invention is involved, the preferred principal effect is the effect of inhibiting the viability and/or the growth of the prokaryotic micro-organism, preferably *Helicobacter pylori, Staphylococcus aureus* or *Streptococcus pneumoniae*, from which is the protein-protein interaction.

These effects of modulating the viability and/or the growth of prokaryotic micro-organisms can be analysed by any method known by a skilled man.

For example, a screening method of modulating agent can comprise the following steps:

Select one specific interaction.

Transform a permeabilized yeast cell with plasmids containing bait polypeptide and prey polypeptide of the specific interaction.

Plate a top agar containing transformed permeabilized yeast cells on square boxes (that already contains agarose gel).

Apply by spotting the compounds to test on top agar as soon as it is solidified.

Incubate, for example overnight at 30° C., and

Analyse results: select lead compounds that prevent transformed permeabilized yeast cells from growing.

Screening may be used to test compounds capable of modifying the level and/or the specificity of expression of the polynucleotide or the polypeptide encoded by of the invention involved in the protein-protein interaction according to the invention.

A quantitative or qualitative analysis of the expression of the gene encoded the polypeptide of the invention involved in the protein-protein interaction according to the invention can be carried out using primers or probes of the invention as DNA templates, the term DNA templates designating nucleic acids having a sufficient length to allow a specific detection of the expression of mRNAs capable of hybridizing thereto. For example, the DNA templates contain nucleic acids derived from said gene, or sequences complementary thereto for which it is desired to estimate the level or the specificity of expression, and comprising at least 15, at least 25, at least 50, at least 100 or at least 500 consecutive nucleotides.

Another aspect of the present invention consists in methods of identifying molecules capable of binding to one of the set of two polypeptides of the invention involved in the protein-protein interaction. Such molecules can be used to modulate the viability and/or the growth of the prokaryotic micro-organism, preferrably *Helicobacter pylori*, from which is the protein-protein interaction activity. For example, such molecules can be used to stimulate or to inhibit a biological reaction involved in the viability and/or the growth of the prokaryotic micro-organism.

Numerous methods well known by the skilled man exist for identifying ligands for a defined polypeptide.

For example to identifying molecules capable of binding to one polypeptide of the set of two polypeptides of the invention involved in the protein-protein interaction, a subunit thereof or a fragment thereof comprising at least 10, at least 20, at least 30, or more than 30 consecutive amino acids with small molecules such as those generated by combinatory chemistry, it is possible to use an HPLC-coupled microdialysis, or an affinity capillary electrophoresis.

In other methods, the peptides or small molecules capable of interacting with said one of the set of two polypeptides of the invention, a subunit thereof or a fragment thereof may be linked to detectable markers such as radioactive, fluorescent or enzymatic markers. These labelled molecules are brought into contact with the immobilized said one of the set of two polypeptides of the invention, under conditions allowing a specific interaction. After elimination of the molecules which are not specifically bound, the bound molecules are detected by appropriate means.

In addition, the peptides or small molecules which bind to said one of the set of two polypeptides of the invention, preferably to its SID® binding site can be identified by competition experiments. In such experiments, said one of the set of two polypeptides of the invention, is immobilized on a surface. Increasing quantities of peptides or of small molecules are brought into contact with the immobilized said one of the set of two polypeptides of the invention in the presence of the second labelled polypeptide of said two polypeptides of the invention, designated labelled ligand. The labelled ligand may be labelled with a radioactive, fluorescent or enzymatic marker. The capacity of the molecule tested to interact with said one of the set of two polypeptides of the invention is determined by measuring the quantity of labelled ligand bound in the presence of the molecule tested. A decrease in the quantity of bound ligand when the molecule tested is present indicates that the latter is capable of interacting with said one of the set of two polypeptides of the invention.

The Biacore™ technology can also be used to carry out the screening of compounds capable of interacting with said one of the set of two polypeptides of the invention. This technology is described in Szabo et al. (1995) and in Edwards and Leartherbarrow (Analytical Biochemistry, 246, 1–6, 1997), of which the teaching is incorporated by reference, and makes it possible to detect interactions between molecules in real time without the use of labelling.

One of the main advantages of this method is that it allows the determination of the association constants between said one of the set of two polypeptides of the invention and the interacting molecules. Thus, it is possible to specifically select the molecules interacting with high or low association constants.

The proteins or other molecules interacting said one of the set of two polypeptides of the invention can be identified using affinity columns which contain said one of the set of two polypeptides of the invention. Said one of the set of two polypeptides of the invention may be attached to the column using conventional techniques including chemical coupling to an appropriate column matrix such as agarose, Affi Gel, or other matrices known to a person skilled in the art. In another aspect of the invention, the affinity column may contain chimeric proteins in which said one of the set of two polypeptides of the invention would be fused, for example, with glutathione S-transferase. The molecules to be tested which are described above are then deposited on the column. The molecules interacting said one of the set of two polypeptides of the invention are retained by the column and can be isolated by elution.

The chemical or biochemical compounds, characterized in that they make it possible to modulate, directly or indirectly, the protein-protein interaction according to the invention, and selected by the said methods defined above, also form part of the invention.

The use of a polypeptide according to the invention for the modulation of *Helicobacter pylori's* protein interaction, also forms part of the present invention.

Still another aspect, the present invention is directed to a method for the production of monoclonal or polyclonal antibodies comprising the step of immunization of an animal or human organism with an immunogenic agent comprising a polypeptide, a vector according or a host cell according to the invention, and to antibodies obtained by said method.

The mono- or polyclonal antibodies or fragments thereof, chimeric or immuno-conjugated antibodies, characterized in that they are capable of specifically recognizing a polypeptide according to the invention, also form part of the invention.

As used herein, the term "antibody" refers to a polypeptide or group of polypeptides which are comprised of at least one binding domain, where an antibody binding domain is formed from the folding of variable domains of an antibody molecule to form three-dimensional binding spaces with an internal surface shape and charge distribution complementary to the features of an antigenic determinant of an antigen, which allows an immunological reaction with the antigen. Antibodies include recombinant proteins comprising the binding domains, as wells as fragments, including Fab, Fab', F(ab)2, and F(ab')2 fragments.

Specific polyclonal antibodies may be obtained from a serum of an animal immunized against a polypeptide according to the invention, in particular produced by genetic recombination or by peptide synthesis, according to the customary procedures, from a polynucleotide according to the invention.

The specific monoclonal antibodies may be obtained according to the conventional hybridoma culture method described by Kohler and Milstein (Kohler, G. and Milstein, C., Nature 256:495, 1975).

The antibodies according to the invention are, for example, chimeric antibodies, humanized antibodies, Fab or F(ab')2 fragments. They may also be in the form of immunoconjugates or of labelled antibodies so as to obtain a detectable and/or quantifiable signal (Harlow, E., and D. Lane. 1988. Antibodies A Laboratory Manual. Cold Spring Harbor Laboratory. pp. 53–242).

The invention also relates to methods for the detection and/or purification of a polypeptide according to the invention, characterized in that they use an antibody according to the invention.

The invention comprises, in addition, purified polypeptides, characterized in that they are obtained by a method according to the invention.

Moreover, in addition to their use for the purification of polypeptides, the antibodies of the invention, in particular the monoclonal antibodies, may also be used for the detection of these polypeptides in a biological sample.

They thus constitute a means for the immunocytochemical or immuno-histochemical analysis of the expression of polypeptide against which they are raised on specific tissue sections, for example by immunofluorescence, gold labelling, enzymatic immunoconjugates.

They make it possible in particular to detect expression of these polypeptides in the biological tissues or samples, which makes them useful for monitoring the progress of a method of prevention or treatment.

More generally, the antibodies of the invention may be advantageously used in any situation where the expression of a polypeptide of the invention against which they are raised needs to be observed.

The invention finally relates to a polynucleotide, a polypeptide, a vector, a host cell, a modulator agent or an antibody to the invention as compound for the preparation of a medicament.

So the invention also encompasses a pharmaceutical composition comprising a compound selected from the group consisting of:
a) a polynucleotide according to the invention;
b) a polypeptide according to the invention;
c) a vector according to the invention;
d) a host cell according to the invention;
e) a modulator agent to the invention; and
f) an antibody to the invention.

A pharmaceutical composition according to the invention, wherein said composition is administered by any route such as intravenous route, intramuscular route, oral route, or mucosal route with an acceptable physiological carrier and/or adjuvant, also forms part of the invention.

The compounds according to the invention as a medicament for the prevention and/or treatment of pathologies of infection diseases induced by prokaryotic micro-organism are particularly preferred.

The most preferred are the compounds according to the invention, as a medicament for the prevention and/or treatment of infection diseases induced by *Helicobacter pylori, Staphylococcus aureus* or *Streptococcus pneumoniae*.

The compounds of the invention as active ingredients of a medicament will be preferably in soluble form, combined with a pharmaceutically acceptable vehicle.

Such compounds which can be used as a medicament offer a new approach for preventing and/or treating pathologies linked to infection by prokaryotic micro-organism such as *Helicobacter pylori, Staphylococcus aureus* or *Streptococcus pneumoniae*. Preferably, these compounds will be administered by the systemic route, in particular by the intravenous route, by the intramuscular or intradermal route or by the oral route.

Their modes of administration, optimum dosages and galenic forms can be determined according to the criteria generally taken into account in establishing a treatment suited to a patient, such as for example the age or body weight of the patient, the seriousness of his general condition, the tolerance to treatment and the side effects observed, and the like.

The identified compounds can be administered to a mammal, including a human patient, alone or in pharmaceutical compositions where they are mixed with suitable carriers or excipient(s) at therapeutically effective doses to treat disorders associated with prokaryotic micro-organism infection. Techniques for formulation and administration of the compounds of the instant application may be found in "Remington's Pharmaceutical Sciences", Mack Publishing Co., Easton, Pa., latest edition.

Suitable routes of administration include oral, rectal, transmucosal, or intestinal administration, parenteral delivery, including intramuscular, subcutaneous, injections, as well as intravenous, intraperitoneal or intranasal injections.

Pharmaceutical compositions and medicaments for use in accordance with the present invention may be formulated in a conventional manner using one or more physiologically acceptable carriers comprising excipients and auxiliaries. Proper formulation is dependent upon the route of administration chosen.

For injection; the agents of the invention may be formulated in aqueous solutions, preferably in physiologically compatible buffers such as Hanks's solution, Ringer's solution, or physiological saline buffer such as a phosphate or bicarbonate buffer. For transmucosal administration, penetrants appropriate to the barrier to be permeated are used in the formulation. Such penetrants are generally known in the art.

Pharmaceutical preparations which can be used orally include push-fit capsules made of gelatin, as well as soft, sealed capsules made of gelatin and a plasticizer, such as glycerol or sorbitol. The push-fit capsules can contain the active ingredients in admixture with fillers such as lactose, binders such as starches, and/or lubricants such as talc or magnesium stearate and, optionally, stabilizers. In soft capsules, the active compounds may be dissolved or suspended in suitable liquids, such as fatty oils, liquid paraffin, or liquid polyethylene glycols. In addition, stabilizers may be added. All formulations for oral administration should be in dosages suitable for such administration.

For buccal administration, the compositions may take the form of tablets or lozenges formulated in conventional manner.

For administration by inhalation, the compounds for use according to the present invention are conveniently delivered in the form of an aerosol spray presentation from pressurized packs or a nebulizer, with the use of a suitable gaseous propellant, e.g., carbon dioxide. In the case of a pressurized aerosol the dosage unit may be determined by providing a valve to deliver a metered amount. Capsules and cartridges of, e.g., gelatin, for use in an inhaler or insufflator, may be formulated containing a powder mix of the compound and a suitable powder base such as lactose or starch.

The compounds may be formulated for parenteral administration by injection, e.g., by bolus injection or continuous infusion. Formulations for injection may be presented in unit dosage form, e.g., in ampoules or in multi-dose containers, with an added preservative. The compositions may take such forms as suspensions, solutions or emulsions in aqueous vehicles, and may contain formulatory agents such as suspending, stabilizing and/or dispersing agents.

Pharmaceutical formulations for parenteral administration include aqueous solutions of the active compounds in water-soluble form. Aqueous suspensions may contain substances which increase the viscosity of the suspension, such as sodium carboxymethyl cellulose, sorbitol, or dextran. Optionally, the suspension may also contain suitable stabilizers or agents which increase the solubility of the compounds to allow for the preparation of highly concentrated solutions.

Alternatively, the active ingredient may be in powder or lyophilized form for constitution with a suitable vehicle, such as sterile pyrogen-free water, before use.

Additionally, the compounds may be delivered using a sustained-release system, such as semipermeable matrices of solid hydrophobic polymers containing the therapeutic agent. Various sustained-release materials have been established and are well known by those skilled in the art. Sustained-release capsules may, depending on their chemical nature, release the compounds for a few weeks up to over 100 days.

Depending on the chemical nature and the biological stability of the therapeutic reagent, additional strategies for protein stabilization may be employed.

The pharmaceutical compositions also may comprise suitable solid or gel phase carriers or excipients. Examples of such carriers or excipients include but are not limited to calcium carbonate, calcium phosphate, various sugars, starches, cellulose derivatives, gelatin, and polymers such as polyethylene glycols.

Pharmaceutical compositions suitable for use in the present invention include compositions wherein the active ingredients are contained in an effective amount to achieve their intended purpose. More specifically, a therapeutically effective amount means an amount effective to prevent development of or to alleviate the existing symptoms of the subject being treated. Determination of the effective amounts is well within the capability of those skilled in the art, especially in light of the detailed disclosure provided herein.

For any compound used in the method of the invention, the therapeutically effective dose can be estimated initially from cell culture assays. For example, a dose can be formulated in animal models to achieve a circulating concentration range that includes or encompasses a concentration point or range shown the desired effect in an in vitro system. Such information can be used to more accurately determine useful doses in humans.

A therapeutically effective dose refers to that amount of the compound that results in amelioration of symptoms in a patient. Toxicity and therapeutic efficacy of such compounds can be determined by standard pharmaceutical procedures in cell cultures or experimental animals, e.g., for determining the LD50, (the dose lethal to 50% of the test population) and the ED50 (the dose therapeutically effective in 50% of the population). The dose ratio between toxic and therapeutic effects is the therapeutic index and it can be expressed as the ratio between LD50 and ED50. Compounds which exhibit high therapeutic indices are preferred.

The data obtained from these cell culture assays and animal studies can be used in formulating a range of dosage for use in human. The dosage of such compounds lies preferably within a range of circulating concentrations that include the ED50, with little or no toxicity. The dosage may vary within this range depending upon the dosage form employed and the route of administration utilized. The exact formulation, route of administration and dosage can be chosen by the individual physician in view of the patient's condition (see, e.g., Fingl et al., 1975, in "The Pharmacological Basis of Therapeutics", Ch. 1).

Dosage amount and interval may be adjusted individually to provide plasma levels of the active compound which are sufficient to maintain the modulating effects. Dosages necessary to achieve the modulating effect will depend on individual characteristics and route of administration.

The amount of composition administered will, of course, be dependent on the subject being treated, on the subject's weight, the severity of the affliction, the manner of administration and the judgment of the prescribing physician.

Other characteristics and advantages of the invention appear in the remainder of the description with the examples and figures whose legends are represented below.

EXAMPLES

Medium composition and standard protocols are available in Sambrook and Maniatis (Sambrook, J., Fritsch, E. F., and T. Maniatis. (1989) Molecular Cloning: A Laboratory Manual. 2ed. Cold Spring Harbor Laboratory, Cold Spring Harbor, N.Y.).

Example 1

Preparation of a *Helicobacter pylori* Genomic Collection

1.A. Collection Preparation and Transformation in *Escherichia coli*

1.A 1. Fragmented of Genomic DNA Preparation

The *Helicobacter pylori* genomic DNA is fragmented in a nebulizer (GATC) for 1 minute, precipitated and resuspended in water.

The obtained nebulized genomic DNA is successively treated with Mung Bean Nuclease (Biolabs) (30 minutes at 30° C.), T4 DNA polymerase (Biolabs) (10 minutes at 37° C.) and Klenow enzyme (Pharmacia) (10 minutes at room temperature and 1 hour at 16° C.).

DNA is then extracted, precipitated and resuspended in water.

1.A.2. Ligation of Linkers to Blunt-ended Genomic DNA

Oligonucleotide PL160 (5' end phosphorylated) 1 µg/µl and PL159 2 µg/µl.

Sequence of the oligo PL160: 5'-ATCCCGGACGAAGG CC-3'.

Sequence of the oligo PL159: 5'-GGCCTTCGTCCGG-3'.

Linkers were preincubated (5 minutes at 95° C., 10 minutes at 68° C., 15 minutes at 42° C.) then cooled down at room temperature and ligated with genomic DNA inserts at 4° C. overnight.

Linkers were further removed on a separation column (Chromaspin TE 400, Clontech), according to the manufacturer protocol.

1.A.3. Vector Preparation pACTIIst is successively digest with BamHI restriction enzyme (Biolabs) for 1 hour at 37° C., dephosphorylated with Calf Intestine Phosphatase (CIP) (Biolabs) and filled in with dGTP using Vent DNA polymerase (exo-) (Biolabs), extracted, precipitated and resuspended in water.

1.A.4. Ligation Between Vector and Insert of Genomic DNA

The prepared vector is ligated overnight at 15° C. with the genomic blunt ended DNA described in section 2 using T4 DNA ligase (Biolabs). The DNA is then precipitated and resuspended in water.

1.A.5. Library Transformation in *Escherichia coli*

Transform DNA from section 1.A.4 into Electromax DH10B electrocompetent cells (Gibco BRL) with Cell Porator apparatus (Gibco BRL). Add 1 ml SOC medium and incubate transformed cells at 37° C. for 1 hour. Add 9 ml volume of SOC medium per tube and plate on LB+ampicillin medium. Scrape colonies with liquid LB medium. Aliquot and freeze at −80° C.

The obtained collection of recombinant cell clones is named HGXBHP1 (CNCM No I-2181 deposited on Apr. 13, 1999).

1.B. Collection Transformation in *Saccharomyces cerevisiae*

The *Saccharamyces cerevisiae* strain (Y187 (MATα Gal4Δ Gal80Δ ade2-101 His3 Leu2-3, −112 Trp1-901 Ura3-52 URA3::UASGAL1-LacZ Met)) transformed with the HGXBHP1 *H. pylori* genomic DNA library.

The plasmid DNA contained in *E. coli* are extracted (Qiagen) from aliquoted *E. coli* frozen cells (1.A.5.).

Grow *Saccharomyces cerevisiae* yeast Y187 in YPGlu.

Yeast transformation is performed according to standard protocol (Giest et al. Yeast, 11, 355–360, 1995) using yeast carrier DNA (Clontech). This experiment leads to $10^4$ to $5.10^4$ cells/µg DNA. Spread an estimating of $2.10^4$ transformanton DO-Leu (Drop-out) medium per plates. Aliquot and freeze at −80° C.

1.C. Construction of Bait Plasmid

The genomic amplification of the ORF is obtained by PCR using the Pfu proofreading Taq polymerase (Stratagene) and 200 ng of genomic DNA as template. PCR primers are chosen in regions flanking the ORF.

Set up the PCR program as followed:

| | | |
|---|---|---|
| 94° | 45" | |
| 94° | 45" | |
| 48° | 45" | ] × 30 cycles |
| 72° | 6' | |
| 72° | 10' | |
| 15° | ∞ | |

Check amplification on agarose gel.

Purify PCR fragments with Qiaquick column (Qiagen) according to the manufacturer protocol.

Digest purified PCR fragments with adequate restriction enzymes.

Purify PCR fragments with Qiaquick column (Qiagen) according to the manufacturer protocol.

Ligate digested PCR fragments into an adequately digested and dephosphorylated bait vector (pAS2ΔΔ) according to standard protocol (Maniatis et al.).

Transform into competent bacterial cells. Grow cells, extract DNA and sequence plasmid.

This protocole may also be applied to *E. coli*, *S. aureus* and *S. pneumoniae* genomic DNA Example 2

Screening the Collection with the Two-hybrid in Yeast System

2.A. The Mating Protocol

We have chosen the mating two-hybrid in yeast system (firstly described by Fromont Racine et al., Nature Genetics, 1997, vol. 16, 277–282, Toward a functional analysis of the yeast genome through exhaustive two-hybrid screens) for its advantages but we could also screen the *Helicobacter pylori* collection in classical two-hybrid system as described in Fields et al. or in a yeast reverse two-hybrid system.

The mating procedure allows a direct selection on selective plates because the two fusion proteins are already produced in the parental cells. No replica plating is required.

This protocol is written for the use of the library transformed into the Y187 strain.

Before mating, transform *S. cerevisiae* (CG 1945 strain (MATa Gal4-542 Gal180-538 ade2-101 His3*200 Leu2-3,−112 Trp1-901 Ura3-52 Lys2-801 URA3::GAL4 17 mers (X3)-CyC1TATA-LacZ LYS2::GAL1UAS-GAL1TATA-HIS3 CYH$^R$)) according to step 1.B. and spread on DO-Trp medium.

Day 1. Morning: Preculture

Preculture of Y187 cells carrying the bait plasmid obtained at step 1.C. in 20 ml DO-Trp medium. Grow at 30° C. with vigorous agitation.

Day 1. Late Afternoon: Culture

Measure $OD_{600nm}$ of the DO-Trp preculture of Y187 cells carrying the bait plasmid preculture.

Inoculate 150 ml DO-Trp at $OD_{600nm}$ 0.006/ml, grow overnight at 30° C. with vigorous agitation.

Day 2: Mating

Medium and Plates

5 YPGlu plates (Rich medium with glucose)

50 ml tube with 30 ml DO-Leu-Trp-His 100 ml flask with 20 ml of YPGlu

75 DO-Leu-Trp-His plates

2 DO-Leu plates

2 DO-Trp plates

2 DO-Leu-Trp plates

Measure $OD_{600nm}$ of the DO-Trp culture. It should be around 1.

For the mating, you must use twice as many bait cells as library cells. To get a good mating efficiency, you must collect the cells at $10^8$ cells per cm$^2$.

Estimate the amount of bait culture (in ml) that makes up 80 $OD_{600nm}$ units for the mating with the prokaryote library.

Thaw a vial containing the HGXYHP1 library slowly on ice. Add the contents of the vial to 20 ml YPGlu. Let those cells recover at 30° C., under gentle agitation for 10 minutes.

Mating

Put the 80 $OD_{600nm}$ units of bait culture into a 250 ml flask.

Add the HGXYHP1 library culture to the bait culture. Transfer the mixture of diploids into 50 ml sterile tubes.

Centrifuge, discard the supernatant and resuspend in YPGlu medium.

Distribute cells on YPGlu Plates (Rich medium with glucose).

Incubate plates cells-up at 30° C. for 4 h 30 min.

Collection of Mated Cells

Wash and rinse plates and spread collected cells on DO-Leu-Trp-His plates.

Day 4

Selection of clones capable of growing on DO-Leu-Trp-His: this medium allows us to isolate diploid clones presenting an interaction.

Count the His+ colonies on control plates.

The number of His+ cell clones will define which protocol is to be processed: Upon 20.10⁶ His+ colonies:

if number of His+ cell clones>285: then process overlay and then luminometry protocols on blue colonies (2.B and 2.C);

if number of His+ cell clones<285: process luminometry protocol (2.C).

The following step leads to the selection of the strongest interaction.

2.B. The X-Gal Overlay Assay

X-Gal overlay assay is performed directly on the selective medium plates after scoring the number of His$^+$ colonies.

Material

Set up a waterbath. The water temperature should be 50° C.

0.5 M $Na_2HPO_4$ pH 7.5.

1.2% Bacto-agar.

2% X-Gal in DMF (dimethyl formamide).

Overlay mixture: 0.25 M $Na_2HPO_4$ pH7.5, 0.5% agar, 0.1% SDS (Sodium dodecyl sulfate), 7% DMF (LABOSI), 0.04% X-Gal (ICN). For each plate, 10 ml overlay mixture are needed.

DO-leu-trp-his plates.

Sterile toothpicks.

Experiment

Temperature of the overlay mix should be between 45 and 50° C.

Pour the overlay-mix over the plates in portions of 10 ml. Collect them when the top layer is settled.

Incubate plates overlay-up at 30° C. Note the time.

Check for blue colonies regularly. If no blue colony appears, wait for overnight incubation. Mark with a pen and number the positives.

Streak the positives colonies on fresh DO-Leu-Trp-His plates with a sterile toothpick.

2.C. The Luminometry Assay

Grow His+ colonies overnight at 30° C. in microtiter plates containing DO-Leu-Trp-His+Tetracyclin medium with shaking. The day after, dilute 15 times overnight culture into a new microtiter plate containing the same medium. Incubate 5 hours at 30° C. with shaking. Dilute samples 5 times and read $OD_{600nm}$. Dilute again to obtain between 10000 and 75000 yeast cells/well in 100 μl final volume.

Per well, add 76 μl of One Step Yeast Lysis Buffer (Tropix), 20 μl SapphireII Enhancer (Tropix), 4 μl Galacton Star (Tropix), incubate 40 minutes at 30° C.

Measure the β-Gal read-out (L) using a Luminometer (Trilux, Wallach).

Calculate value of $OD_{600nm}$/L and select interacting preys having highest values.

At this step of the protocol, we have isolated diploid cell clones presenting interaction. The next step is now to identify polypeptides involved in the selected interactions.

Example 3

Identification of Positive Clones

3.A. PCR on Yeast Colonies

Introduction

PCR amplification of fragments of plasmid DNA directly on yeast colonies is a quick and efficient procedure to identify sequences cloned into this plasmid. It is directly derived from a published protocol (Wang H. et al., Analytical Biochemistry, 237, 145–146, 1996). However, it is not a standardized protocol: in our hands it varies from strain to strain, it is dependent of experimental conditions (number of cells, Taq polymerase source, etc.). This protocol should be optimized to specific local conditions.

Materials

For 1 well, PCR mix composition is:

32.5 μl water,

5 μl 10×PCR buffer (Pharmacia),

1 μl dNTP (10 mM each)

0.5 μl Taq polymerase (5u/μl) (Pharmacia), 0.5 μl oligonucleotide ABS1 10 pmole/μl: 5'-GCGTTTGGAATCACTACAGG-3', 0.5 μl oligonucleotide ABS2 10 pmole/μl: 5'-CACGATGCACGTTGAAGTG-3'.

1 N NaOH.

Experiment

Grow positive colonies overnight at 30° C. on a 96 well cell culture cluster (Costar), containing 150 μl DO-Leu-Trp-His+Tetracyclin with shaking. Resuspend culture and transfer immediately 100 μl on a Thermowell 96 (Costar).

Centrifuge 5 minutes at 4000 rpm at room temperature.

Remove supernatant.

Place the Thermowell in the thermocycler (GeneAmp 9700, Perkin Elmer) 5 minutes at 99.9° C. and then 10 minutes at 4° C.

Add lysis buffer and incubate.

Centrifuge, transfer aliquot of supernatant in each well, add PCR mix, shake well.

Set up the PCR program as followed:

| | | |
|---|---|---|
| 94° C. | 3 minutes | |
| 94° C. | 30 secondes | |
| 53° C. | 1 minute 30 secondes | ] × 35 cycles |
| 72° C. | 3 minutes | |
| 72° C. | 5 minutes | |
| 15° C. | ∞ | |

Check the quality, the quantity and the length of the PCR fragment on agarose gel.

The length of the cloned fragment is the estimated length of the PCR fragment minus 300 base pairs that correspond to the amplified flanking plasmid sequences.

3.B. Plasmids Rescue from Yeast by Electroporation

Introduction

The previous protocol of PCR on yeast cell may not be successful, in such a case, we rescue plasmids from yeast by electroporation. This experiment allows the recovery of prey plasmids from yeast cells by transformation of *E. coli* with a yeast cellular extract. We can then amplify the prey plasmid and sequence the cloned fragment.

Material

Plasmid Rescue

Glass beads 425–600 μm (Sigma)

Phenol/chloroform (1/1) premixed with isoamyl alcohol (Amresco)

Extraction buffer: 2% Triton X100, 1% SDS, 100 mM NaCl, 10 mM TrisHCl pH 8.0, 1 mM EDTA pH 8.0.

Mix ethanol/$NH_4Ac$: 6 volumes ethanol with 7.5 M $NH_4$ Acetate, 70% Ethanol and yeast cells in patches on plates.

Electroporation
    SOC medium
    M9 medium
    Selective plates: M9-Leu+Ampicillin
    2 mm electroporation cuvettes (Eurogentech)
Experiment
Plasmid Rescue
    Prepare cell patch on DO-Leu-Trp-His with cell culture of section 2.C.
    Scrape the cell of each patch in Eppendorf tube, add 300 μl of glass beads in each tube, then, add 200 μl extraction buffer and add 200 μl phenol:chloroform:isoamyl alcohol (25:24:1).
    Centrifuge tubes 10 minutes at 15000 rpm.
    Transfer 180 μl supernatant to a sterile Eppendorf tube and add to each 500 μl ethanol/NH$_4$Ac, vortex.
    Centrifuge tubes 15 minutes, 15000 rpm at 4° C.
    Wash pellet with 200 μl 70% ethanol, remove ethanol and dry pellet.
    Resuspend pellet in 10 μl water. Store extracts at −20° C.
Electroporation
Material: Electrocompetent MC1066 cells prepared according to standard protocols (Maniatis).
    Add 1 μl of yeast plasmid DNA-extract to pre-chilled Eppendorf tube, and keep on ice.
    Mix 1 μl plasmid yeast DNA-extract sample, add 20 μl electrocompetent cells and transfer in a cold electroporation cuvette.
    Set the Biorad electroporator on 200 ohms resistance, 25 μF capacity; 2.5 kVolts.
    Place cuvette in the cuvette holder and electroporate.
    Add 1 ml SOC into the cuvette and transfer the cell-mix into sterile Eppendorf tube.
    Let cells recover for 30 minutes at 37° C., spin the cells down 1 minute, 4000×g and pour off supernatant. Keep about 100 μl medium and use it to resuspend the cells and spread them on selective plates (e.g. M9-Leu plates).
    Incubate plates for 36 hours at 37° C.
    Grow one colony and extract plasmids. Check presence and size of insert through enzymatic digestion and agarose gel. Sequence insert.

Example 4

Protein-Protein Interactions

For the purpose of this example, we have chosen to study *Helicobacter pylori*'s protein-protein interactions.

For each bait, the previous protocol leads to the identification of prey polynucleotide sequences. In order to identify a protein-protein interaction, we need to characterize the obtained prey polypeptide sequence regarding the *Helicobacter pylori* genome.

This may be accomplish with a software program names blastwun (available on the Internet site of the University of Washington: http://bioweb.pasteur.fr/seqanal/interfaces/blastwu.html, this is a development version of software for gene and protein identification through similarity searches of protein and nucleotide sequence databases).

Blastwun program compares prey polypeptide insert sequence (rescued from prey plasmid) with whole *Helicobacter pylori* genome (available on N.C.B.I. web site: http://lwww.ncbi.nlm.nih.gov under GenBank accession number AE000511). This comparison leads to prey polynucleotide localizations in *H. pylori* genome, each localization having a score depending on the homology of sequence. For each prey polynucleotide, we consider the localization with the highest score and, if the insert sequence is included in and is in phase with an Open Reading Frame, we can identify one prey polypeptide interacting with one bait polypeptide.

*Helicobacter pylori* ORF's sequences are available on the World-Wide Web site of The Institute for Genomic Research (TIGR) at http://www.tigr.org/tdb/mbd/hpdb/hpdb.html.

This web page allows several request concerning *Helicobacter pylori*'s genome, in particular, its ORF sequence. To get the sequences of a specific ORF, click on the window named <<HP#>> and click search. This operation leads to a new web page presenting nucleic and peptide sequence of the specific ORF.

Table I: Protein Interaction in *Helicobacter pylori* (see hereafter)

Example 5

Identification of SID®

Experiment results in step 4. sequences of each prey fragment encoding for an interacting prey polypeptide.

Figure 7:
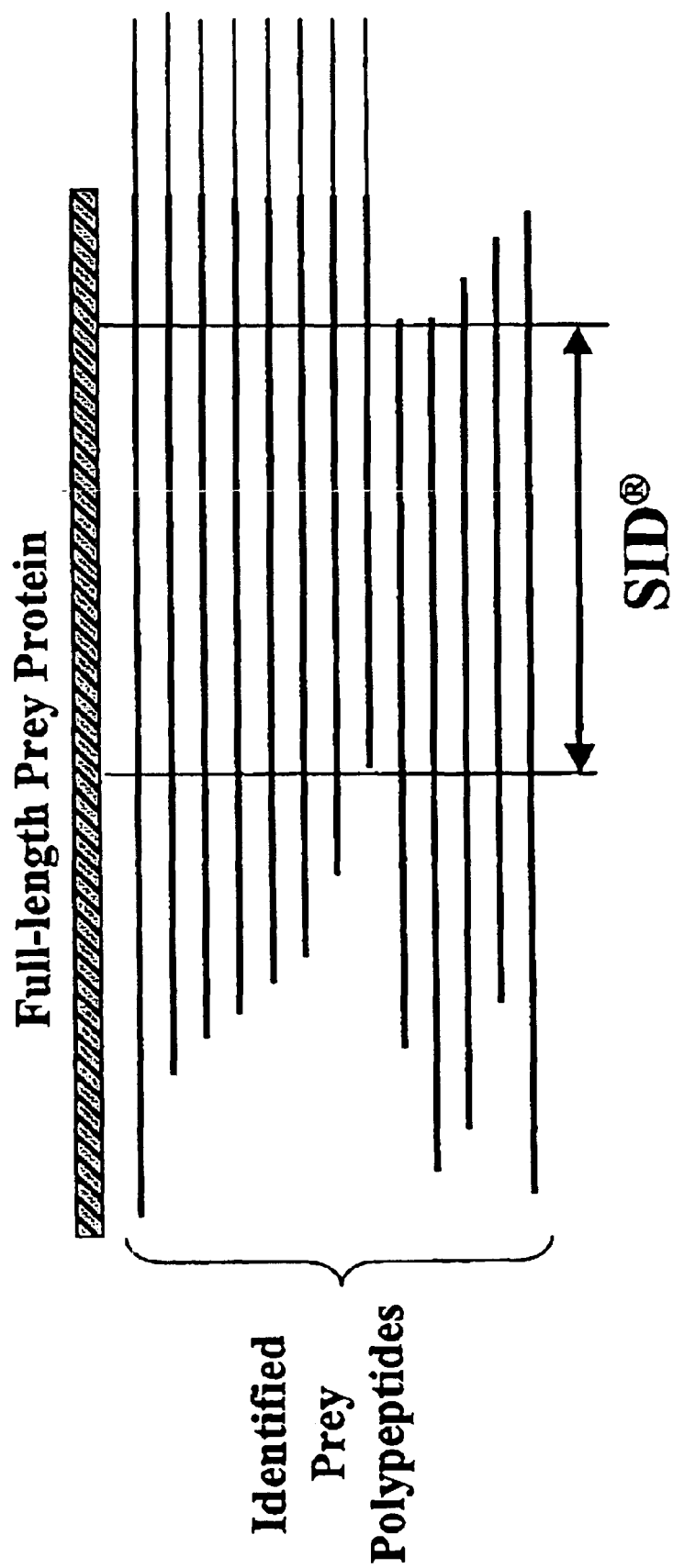
FIG. 7 is a schematic representation of the SID® identification method. In this figure, the <<Full-length prey protein>> is the Open Reading Frame where the identified prey polypeptides are included, the Selected Interaction Domain SID® is determined by comparison of every prey polypeptide fragment.
Figure 8:
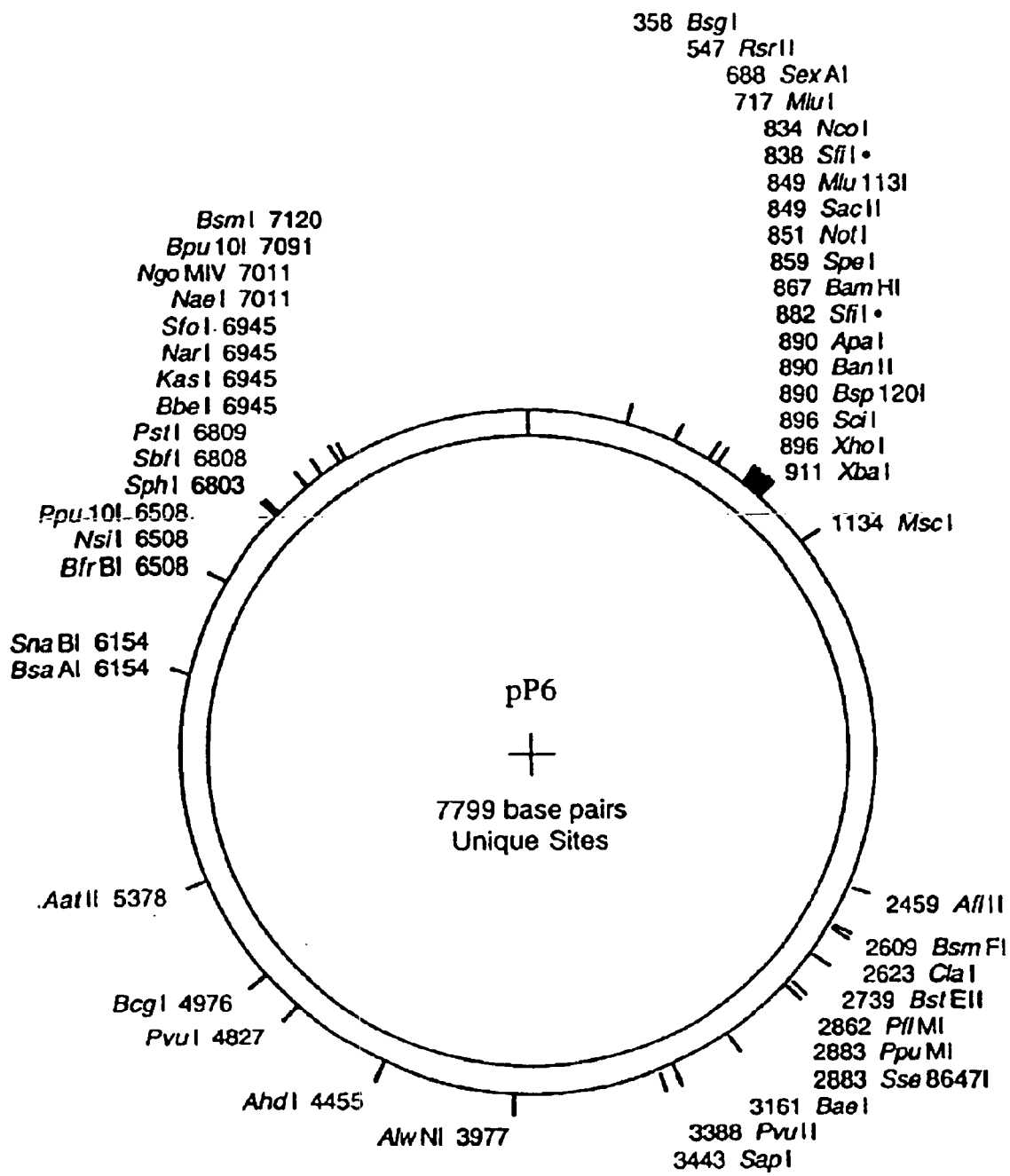
FIG. 8 is a restriction map of the plasmid pP6 which may be used for the yeast two-hybrid system.

By comparing and selecting the intersection of every isolated fragments that are included in the same polypeptide, we define the Selected Interacting Domain (SID®) see FIG. 7.

See Results in Tables II and III.

TABLE I

Interaction involving polypeptides including *Helicobacter pylori* ORF

| Bait polypeptides (ORF reference according to Tomb et al.) | Interacting ORF (ORF reference according to Tomb et al.) |
|---|---|
| HP0047 | HP0047 |
| HP0047 | HP0048 |
| HP0047 | HP0695 |
| HP0061 | HP0066 |
| HP0061 | HP0978 |
| HP0061 | HP1409 |
| HP0064 | HP0063 |
| HP0066 | HP0066 |
| HP0067 | HP0069 |
| HP0067 | HP0609 |
| HP0067 | HP0768 |
| HP0067 | HP0770 |
| HP0067 | HP0956 |
| HP0068 | HP0070 |
| HP0068 | HP0118 |
| HP0069 | HP0067 |
| HP0070 | HP0068 |
| HP0070 | HP0070 |
| HP0071 | HP0278 |
| HP0071 | HP0417 |
| HP0071 | HP0570 |
| HP0071 | HP0775 |
| HP0071 | HP1340 |
| HP0071 | HP1409 |
| HP0072 | HP1489 |
| HP0073 | HP0073 |
| HP0073 | HP0232 |
| HP0073 | HP0259 |
| HP0073 | HP0067 |
| HP0073 | HP0232 |
| HP0073 | HP0705 |
| HP0268 | HP1198 |
| HP0289 | HP0289 |
| HP0289 | HP0289 |
| HP0289 | HP0887 |
| HP0289 | HP0922 |
| HP0289 | HP1038 |
| HP0289 | HP1543 |
| HP0289 | HP0289 |
| HP0289 | HP0289 |

TABLE I-continued

Interaction involving polypeptides including *Helicobacter pylori* ORF

| Bait polypeptides (ORF reference according to Tomb et al.) | Interacting ORF (ORF reference according to Tomb et al.) |
|---|---|
| HP0289 | HP0610 |
| HP0289 | HP1355 |
| HP0311 | HP0312 |
| HP0338 | HP0132 |
| HP0338 | HP0337 |
| HP0391 | HP0099 |
| HP0391 | HP0392 |
| HP0691 | HP0692 |
| HP0691 | HP1362 |
| HP0697 | HP0012 |
| HP0697 | HP0048 |
| HP0697 | HP0558 |
| HP0697 | HP0599 |
| HP0697 | HP0696 |
| HP0697 | HP0864 |
| HP0697 | HP1037 |
| HP0697 | HP1038 |
| HP0697 | HP1299 |
| HP0697 | HP1576 |
| HP0776 | HP0067 |
| HP0776 | HP0278 |
| HP0776 | HP1378 |
| HP0776 | HP1409 |
| HP0797 | HP0289 |
| HP0797 | HP0887 |
| HP0797 | HP1349 |
| HP0797 | HP1377 |
| HP0797 | HP1409 |
| HP0800 | HP0433 |
| HP0800 | HP0687 |
| HP0800 | HP0800 |
| HP0800 | HP0801 |
| HP0800 | HP0924 |
| HP0800 | HP1267 |
| HP0800 | HP1460 |
| HP0801 | HP0152 |
| HP0801 | HP0800 |
| HP0801 | HP1513 |
| HP0868 | HP0088 |
| HP0868 | HP0327 |
| HP0868 | HP0869 |
| HP0868 | HP1142 |
| HP0874 | HP0875 |
| HP0875 | HP0874 |
| HP0887 | HP0459 |
| HP0887 | HP0610 |
| HP0887 | HP0699 |
| HP0887 | HP0887 |
| HP0887 | HP1157 |
| HP0887 | HP1460 |
| HP0887 | HP1464 |
| HP0887 | HP0610 |
| HP0887 | HP0887 |
| HP0887 | HP1157 |
| HP0887 | HP1464 |
| HP0935 | HP0072 |
| HP0935 | HP0528 |
| HP0935 | HP0657 |
| HP0978 | HP0979 |
| HP0978 | HP1583 |
| HP1032 | HP0643 |
| HP1032 | HP0818 |
| HP1032 | HP1122 |
| HP1032 | HP1198 |
| HP1032 | HP1316 |
| HP1067 | HP0392 |
| HP1198 | HP0088 |
| HP1198 | HP0268 |
| HP1198 | HP0293 |
| HP1198 | HP0452 |
| HP1198 | HP0705 |
| HP1198 | HP0775 |
| HP1198 | HP0965 |
| HP1198 | HP1032 |
| HP1198 | HP1114 |
| HP1198 | HP1124 |
| HP1198 | HP1198 |
| HP1198 | HP1274 |
| HP1198 | HP1378 |
| HP1198 | HP1411 |
| HP1198 | HP1541 |
| HP1198 | HP1032 |
| HP1198 | HP1218 |
| HP1230 | HP1230 |
| HP1230 | HP1529 |
| HP1231 | HP1247 |
| HP1244 | HP0857 |
| HP1244 | HP1246 |
| HP1246 | HP0121 |
| HP1246 | HP0326 |
| HP1246 | HP0407 |
| HP1246 | HP0886 |
| HP1246 | HP1035 |
| HP1246 | HP1244 |
| HP1246 | HP1460 |
| HP1247 | HP1231 |
| HP1247 | HP1353 |
| HP1293 | HP1198 |

* Tomb et al., 1997, Nature, 388, 539–547

As indicated page 547 in the document Tomb et al., the annotated *H. pylori* genome sequence and gene family alignments are available on the World-Wide Web site at http://www.tigr.org/tdb/mbd/hpdb/hpdb.html. For each ORF referenced HPXXXX, the detailed nucleic sequence, and amino acids sequence encoded by, can be obtained on the World-Wide Web site at http://www.tigr.org/tdb/mbd/hpdb/hpdb.html. by introducing said reference HPXXXX (see example 4).

TABLE II

| Bait polypeptides (ORF reference according to Tomb et al.) | SID® Amino Acid Sequence (SEQ ID N°) |
|---|---|
| HP0868 | 2 |
| HP0868 | 4 |
| HP0868 | 6 |
| HP0868 | 8 |
| HP0800 | 10 |
| HP0800 | 12 |
| HP0800 | 14 |
| HP0800 | 16 |
| HP0800 | 18 |
| HP0800 | 20 |
| HP0800 | 22 |
| HP0801 | 24 |
| HP0801 | 26 |
| HP0801 | 28 |
| HP0887 | 30 |
| HP0887 | 32 |
| HP0887 | 34 |
| HP0887 | 36 |
| HP0887 | 38 |
| HP0887 | 40 |
| HP0887 | 42 |
| HP0289 | 44 |
| HP0289 | 46 |

TABLE II-continued

| Bait polypeptides (ORF reference according to Tomb et al.) | SID ® Amino Acid Sequence (SEQ ID N°) |
|---|---|
| HP0289 | 48 |
| HP0289 | 50 |
| HP0289 | 52 |
| HP0289 | 54 |
| HP0289 | 56 |
| HP0289 | 58 |
| HP0289 | 60 |
| HP0289 | 62 |
| HP0068 | 64 |
| HP0068 | 66 |
| HP0047 | 68 |
| HP0047 | 70 |
| HP0047 | 72 |
| HP0069 | 74 |
| HP0066 | 76 |
| HP0268 | 78 |
| HP1293 | 80 |
| HP0061 | 82 |
| HP0061 | 84 |
| HP0061 | 86 |
| HP0064 | 88 |
| HP1198 | 90 |
| HP1198 | 92 |
| HP1198 | 94 |
| HP1198 | 96 |
| HP1198 | 98 |
| HP1198 | 100 |
| HP1198 | 102 |
| HP1198 | 104 |
| HP1198 | 106 |
| HP1198 | 108 |
| HP1198 | 110 |
| HP1198 | 112 |
| HP1198 | 114 |
| HP1198 | 116 |
| HP1198 | 118 |
| HP1231 | 120 |
| HP1032 | 122 |
| HP1032 | 124 |
| HP1032 | 126 |
| HP1032 | 128 |
| HP1032 | 130 |
| HP1230 | 132 |
| HP1230 | 134 |
| HP1529 | 136 |
| HP0978 | 138 |
| HP0978 | 140 |
| HP0071 | 142 |
| HP0071 | 144 |
| HP0071 | 146 |
| HP0071 | 148 |
| HP0071 | 150 |
| HP0071 | 152 |
| HP0073 | 154 |
| HP0073 | 156 |
| HP0073 | 158 |
| HP0935 | 160 |
| HP0935 | 162 |
| HP0935 | 164 |
| HP0338 | 166 |
| HP0338 | 168 |
| HP1246 | 170 |
| HP1246 | 172 |
| HP1246 | 174 |
| HP1246 | 176 |
| HP1246 | 178 |
| HP1246 | 180 |
| HP1246 | 182 |
| HP0797 | 184 |
| HP0797 | 186 |
| HP0797 | 188 |

TABLE II-continued

| Bait polypeptides (ORF reference according to Tomb et al.) | SID ® Amino Acid Sequence (SEQ ID N°) |
|---|---|
| HP0797 | 190 |
| HP0797 | 192 |
| HP0311 | 194 |
| HP0067 | 196 |
| HP0067 | 198 |
| HP0067 | 200 |
| HP0067 | 202 |
| HP0067 | 204 |
| HP1244 | 206 |
| HP1244 | 208 |
| HP1067 | 210 |
| HP0875 | 212 |
| HP0776 | 214 |
| HP0776 | 216 |
| HP0776 | 218 |
| HP0776 | 220 |
| HP0697 | 222 |
| HP0697 | 224 |
| HP0697 | 226 |
| HP0697 | 228 |
| HP0697 | 230 |
| HP0697 | 232 |
| HP0697 | 234 |
| HP0697 | 236 |
| HP0697 | 238 |
| HP0697 | 240 |
| HP0887 | 242 |
| HP0887 | 244 |
| HP0887 | 246 |
| HP0887 | 248 |
| HP1247 | 250 |
| HP1247 | 252 |
| HP0874 | 254 |
| HP0072 | 256 |
| HP0391 | 258 |
| HP0391 | 260 |
| HP0070 | 262 |
| HP0070 | 264 |
| HP0691 | 266 |
| HP0691 | 268 |
| HP1198 | 270 |
| HP1198 | 272 |
| HP0073 | 274 |
| HP0073 | 276 |
| HP0073 | 278 |

TABLE III

| Bait polypeptides (ORF reference according to Tomb et al.) | SID ® Nucleic acid sequence (SEQ ID N°) |
|---|---|
| HP0868 | 1 |
| HP0868 | 3 |
| HP0868 | 5 |
| HP0868 | 7 |
| HP0800 | 9 |
| HP0800 | 11 |
| HP0800 | 13 |
| HP0800 | 15 |
| HP0800 | 17 |
| HP0800 | 19 |
| HP0800 | 21 |
| HP0801 | 23 |
| HP0801 | 25 |
| HP0801 | 27 |
| HP0887 | 29 |
| HP0887 | 31 |
| HP0887 | 33 |
| HP0887 | 35 |
| HP0887 | 37 |
| HP0887 | 39 |

TABLE III-continued

| Bait polypeptides (ORF reference according to Tomb et al.) | SID® Nucleic acid sequence (SEQ ID N°) |
|---|---|
| HP0887 | 41 |
| HP0289 | 43 |
| HP0289 | 45 |
| HP0289 | 47 |
| HP0289 | 49 |
| HP0289 | 51 |
| HP0289 | 53 |
| HP0289 | 55 |
| HP0289 | 57 |
| HP0289 | 59 |
| HP0289 | 61 |
| HP0068 | 63 |
| HP0068 | 65 |
| HP0047 | 67 |
| HP0047 | 69 |
| HP0047 | 71 |
| HP0069 | 73 |
| HP0066 | 75 |
| HP0268 | 77 |
| HP1293 | 79 |
| HP0061 | 81 |
| HP0061 | 83 |
| HP0061 | 85 |
| HP0064 | 87 |
| HP1198 | 89 |
| HP1198 | 91 |
| HP1198 | 93 |
| HP1198 | 95 |
| HP1198 | 97 |
| HP1198 | 99 |
| HP1198 | 101 |
| HP1198 | 103 |
| HP1198 | 105 |
| HP1198 | 107 |
| HP1198 | 109 |
| HP1198 | 111 |
| HP1198 | 113 |
| HP1198 | 115 |
| HP1198 | 117 |
| HP1231 | 119 |
| HP1032 | 121 |
| HP1032 | 123 |
| HP1032 | 125 |
| HP1032 | 127 |
| HP1032 | 129 |
| HP1230 | 131 |
| HP1230 | 133 |
| HP1529 | 135 |
| HP0978 | 137 |
| HP0978 | 139 |
| HP0071 | 141 |
| HP0071 | 143 |
| HP0071 | 145 |
| HP0071 | 147 |
| HP0071 | 149 |
| HP0071 | 151 |
| HP0073 | 153 |
| HP0073 | 155 |
| HP0073 | 157 |
| HP0935 | 159 |
| HP0935 | 161 |
| HP0935 | 163 |
| HP0338 | 165 |
| HP0338 | 167 |
| HP1246 | 169 |
| HP1246 | 171 |
| HP1246 | 173 |
| HP1246 | 175 |
| HP1246 | 177 |
| HP1246 | 179 |
| HP1246 | 181 |
| HP0797 | 183 |
| HP0797 | 185 |
| HP0797 | 187 |
| HP0797 | 189 |
| HP0797 | 191 |
| HP0311 | 193 |
| HP0067 | 195 |
| HP0067 | 197 |
| HP0067 | 199 |
| HP0067 | 201 |
| HP0067 | 203 |
| HP1244 | 205 |
| HP1244 | 207 |
| HP1067 | 209 |
| HP0875 | 211 |
| HP0776 | 213 |
| HP0776 | 215 |
| HP0776 | 217 |
| HP0776 | 219 |
| HP0697 | 221 |
| HP0697 | 223 |
| HP0697 | 225 |
| HP0697 | 227 |
| HP0697 | 229 |
| HP0697 | 231 |
| HP0697 | 233 |
| HP0697 | 235 |
| HP0697 | 237 |
| HP0697 | 239 |
| HP0887 | 241 |
| HP0887 | 243 |
| HP0887 | 245 |
| HP0887 | 247 |
| HP1247 | 249 |
| HP1247 | 251 |
| HP0874 | 253 |
| HP0072 | 255 |
| HP0391 | 257 |
| HP0391 | 259 |
| HP0070 | 261 |
| HP0070 | 263 |
| HP0691 | 265 |
| HP0691 | 267 |
| HP1198 | 269 |
| HP1198 | 271 |
| HP0073 | 273 |
| HP0073 | 275 |
| HP0073 | 277 |

SEQUENCE LISTING (278 sequences)

SEQ ID NO: 1 - DNA, 441 bp, Helicobacter pylori
  CDS (1)..(441)
cgcaaacacattcaagaaaacggcaaagagcctgatttagaagtggtggctgaagaagtggggctttcgttagataaagtgaagaatgtgattaaggtgactaaagagcctatcagtttggaaaccccagtcggcaatgatgatgatggcaagtttggggatttcgtggaagataagaatatcgtcagctccattgatcacatcatgcgagaagatttgaaagcacaaattgaaagcgttttggatcagttgaatgagcgagaaaaagcggtgatccgcatgcgttttgggcttttagacgatgaaagcgatcgaactttagaagaaattggcaaggaattgaatgttactagagaaagggtgcgccagattgaaagctctgcgattaaaaaattgagaagcccgcagtacgggcgcattttaagaaactatttgcgcatt

SEQ ID NO: 2 - protein, 147 aa, Helicobacter pylori
RKHIQENGKEPDLEVVAEEVGLSLDKVKNVIKVTKEPISLETPVGNDDDGKFGDFVEDKNIVSSIDHIMREDLKAQIESVLDQLNEREKAVIRMRFGLLDDESDRTLEEIGKELNVTRERVRQIESSAIKKLRSPQYGRILRNYLRI

SEQ ID NO: 3 - DNA, 363 bp, Helicobacter pylori
  CDS (1)..(363)
cccaaccaccgctattttttgtttaaagaagagggcgtttatttaggggttggctctatcactaaaatcaatttttttcataagcatgggtatttggggatttataaaaacccttttttgaaaaatgggggagaaacgattttaaaagccttggaatttatcgcttttgaagagttccaattacattctttgcatttagaagtgatggaaaacaatttcaaagcgatcgctttttatgaaaaaaaccattatgagttagaggggcgtttgaaaggctttatttctaaagataaggagtttatagacgttcttttgtattataaggataagaaaggatataatgatcaatctcttctaaaactt

SEQ ID NO: 4 - protein, 121 aa, Helicobacter pylori
PNHRYFLFKEEGVYLGVGSITKINFFHKHGYLGIYKNPFLKNGGETILKALEFIAFEEFQLHSLHLEVMENNFKAIAFYEKNHYELEGRLKGFISKDKEFIDVLLYYKDKKGYNDQSLLKL

SEQ ID NO: 5 - DNA, 102 bp, Helicobacter pylori
  CDS (1)..(102)
aacgcgctagattatggggtgtgtgagaaatgccacagcaagaatgttattatcactcaaggcaatgaaatgcgtttgttgtctttagaaatgttagcggaa

SEQ ID NO: 6 - protein, 34 aa, Helicobacter pylori
NALDYGVCEKCHSKNVIITQGNEMRLLSLEMLAE

SEQ ID NO: 7 - DNA, 462 bp, Helicobacter pylori
  CDS (1)..(462)
atggaagactacgcaagcagaaccgctggagcactggagcgacttgataagattgttgaaacagaacagaagaatcaacaaactaaattggacacagaaaatttgaaaataattattgaaactttgagaagtaaaatcaatgggaatcagcaaaagatgcttgataaaagtaaagaaatgagcagaaattttaagcttgatagcactaaaaacgagatagacgcaattaaagatttgattaaaaaggctaatgagcaaatagccaattataatgagatgataaaggatattgaaaaacagaaaaagagttgtaaggaacaaacttggaaatttctagtcaatgaatttaaaagtgatatacaagaatataataaaaagtattgcggtttggagaaaggaataaacaatttagagaaagcaattagtgaaaatcaagaagaggtaaagaaattagaaaatgaa

SEQ ID NO: 8 - protein, 154 aa, Helicobacter pylori
MEDYASRTAGALERLDKIVETEQKNQQTKLDTENLKIIIETLRSKINGNQQKMLDKSKEMSRNFKLDSTKNEIDAIKDLIKKANEQIANYNEMIKDIEKQKKSCKEQTWKFLVNEFKSDIQEYNKKYCGLEKGINNLEKAISENQEEVKKLENE

SEQ ID NO: 9 - DNA, 438 bp, Helicobacter pylori
  CDS (1)..(438)
aaacgccctactatgcccttatttatagagagcttagaaaaagctagcttgcaagtgttagaatgtgaaaattgttcaatgacttattatgatagagattataatagagaatgtgagatttgcccttattgcgatgctaaaaaacctgtcagacttgtagcaacaagttattaccaaaagagcgaagttttttattttgtctcgaattttacagaccctatttttttaccgacaaccttatttaaggggattgaagtggttaaaagcgaatgggagtttgcagagattgctaataatatattgatttttcatcatgacatacaacaagaaaagattctcattaataataaaagattggatcactataggatagaaatagatttagaaaaagaattgactatttcatacaatggttttttaattaaggttcaaaaatgc

SEQ ID NO: 10 - protein, 146 aa, Helicobacter pylori
KRPTMPLFIESLEKASLQVLECENCSMTYYDRDYNRECEICPYCDAKKPVRLVATSYYQKSEVFYFVSNFTDPIFLPTTLFKGIEVVKSEWEFAEIANNILIFHHDIQQEKILINNKRLDHYRIEIDLEKELTISYNGFLIKVQKC

SEQ ID NO: 11 - DNA, 897 bp, Helicobacter pylori
  CDS (1)..(897)
gcttacatggcgacaagaaccttacaaaactataacgaacgactgatcacgctttttgtgatcgggtttatgagctgctcggcaaggctgcctatttatgtgctgtttgtaggctcgtttttcccttcttcaagtgctgggtttgtgctgttttgcatttatattttgggggcggttgtggcgttagtgatggccaaattactcaaattaagcgtgtttaaaggacaaaccgaatcttttatcatggaaatgcccaaataccgctttcccagttggagaatggtctatttcagtatctacaccaaatcgctttcttaccttaaaaaggctgggacttacattttagtgggagcgattttaatctggtttatgtctcaataccctaaaagcgatgcggccatgaaagcttataaacaagaaagcttgttagtgaataaggataccactctttcaagcgaagctaaagaagaaaaattaaaagaattaaaaacagaattggataaaaagaatttaaaaaatagcattgtaggaagaggcggggcgtatttagaaaaagtctttagccctatggattttgattggcgtttgagtgtgtcgcttgtaaccggatttatggctaaagaggtggtggtttctactttgggcgtgttgttttctttaggggatcaaaatgaaaaatctgacgcttttagagggattttaagaaaagaagtcagcgtgcctagcggaatcgcttttatcgtgtttgtgatgttttatatcccttgttttgcagcgaccattacttttggtagggaagcgggagggataaagtttgtagcgtatttattcatcttcacaaccgttgtagcgtatgcgttttccttgatagctttttatgcgactcaaattttggtt

SEQ ID NO: 12 - protein, 299 aa, Helicobacter pylori
AYMATRTLQNYNERLITLFVIGFMSCSARLPIYVLFVGSFFPSSSAGFVLFCIYILGAVVALVMAKLLKLSVFKGQTESFIMEMPKYRFPSWRMVYFSIYTKSLSYLKKAGTYILVGAILIWFMSQYPKSDAAMKAYKQESLLVNKDTTLSSEAKEEKLKELKTELDKKNLKNSIVGRGGAYLEKVFSPMDFDWRLSVSLVTGFMAKEVVVSTLGVLFSLGDQNEKSDAFRGILRKEVSVPSGIAFIVFVMFYIPCFAATITFGREAGGIKFVAYLFIFTTVVAYAFSLIAFYATQILV

SEQ ID NO: 13 - DNA, 423 bp, Helicobacter pylori
  CDS (1)..(423)
attcaaggggcattagatactagggagcttttaaaagcctaccaagaggaagcttgcgcgaaaaactttggagcgttttgtgtgtttgtggggattgtgagaaaagaggataacattcaaggcttgagttttgatatttatgaagcgctattaaagacttggtttgaaaaatggcaccataaagccaaagatttgggcgtggtgttaaaaatggcgcacagcctgggcgatgttttgataggacaaagctcatttttatgcgtttcaatgggaaagaatagaaaaaatgccttagaactatacgaaaattttattgaagattttaagcataacgctcctatttggaaatacgatttaatccataataaacgcatttatgctaaagaaagaagccaccctttaaaagggagcgggcttttagct

SEQ ID NO: 14 - protein, 141 aa, Helicobacter pylori
IQGALDTRELLKAYQEEACAKNFGAFCVFVGIVRKEDNIQGLSFDIYEALLKTWFEKWHHKAKDLGVVLKMAHSLGDVLIGQSSFLCVSMGKNRKNALELYENFIEDFKHNAPIWKYDLIHNKRIYAKERSHPLKGSGLLA

SEQ ID NO: 15 - DNA, 216 bp, Helicobacter pylori
  CDS (1)..(216)
gtagaagtgcgattttttggacccataaaagaagaaaattttttcatcaaagcgaatgatttgaaggaattaagagcgattttacaagaaaaagagggcttaaaagagtggttgggcgtttgcgcgatagcccttaatgatcatttaatagacaatttaaacacgcctttaaaagatggcgatgtaataagtttgttgccaccggtttgtgggggc

SEQ ID NO: 16 - protein, 72 aa, Helicobacter pylori
VEVRFFGPIKEENFFIKANDLKELRAILQEKEGLKEWLGVCAIALNDHLIDNLNTPLKDGDVISLLPPVCGG

SEQ ID NO: 17 - DNA, 156 bp, Helicobacter pylori
  CDS (1)..(156)
aacgagcaaaaacagcaattgattgaaggggtttcagatttgatggttaaggtgctgaataaaaataaggcttctattgtggtcattatagatgaggtcgattctaataattatggtcttgggggcgagagcgtccatcatttgaggcaaaaaaac

SEQ ID NO: 18 - protein, 52 aa, Helicobacter pylori
NEQKQQLIEGVSDLMVKVLNKNKASIVVIIDEVDSNNYGLGGESVHHLRQKN

SEQ ID NO: 19 - DNA, 600 bp, Helicobacter pylori
  CDS (1)..(600)
atttatgcgcctattttagccgggcttgcctctaataacaaatactctttaattggctccgcaagagcgacgatccaactgctcagctttgaagtggtcagcactttaaccattctagcccccttaatggtggtaggatcgctctctttagtggaaatcaatcattaccaaagcggtgggtttttagactggcttgtgtttaagcagcctctagcgtttgttttgtttttgatcgcaagttatgccgaattgaatcgaaccccctttgacttgctagagcatgaagccgagatcgtggcggggtattgcaccgaatacagcggcttgaaatggggcatgttctttttagcggaatacgcgcatttattcgctttttcttttgtgatttctattgtgttttttggcgggtttaacgcatggggctttatccctggaggcatagcgattttgattaaagcgggcttttttgtctttttatccatgtgggttagagcgacttatccgcatgtgcgcccagaccaactgatggatatgtgctggaaaatcatgctgcctttagcgttattgaacattgtgctaacgggcattatcattttaatt

SEQ ID NO: 20 - protein, 200 aa, Helicobacter pylori
IYAPILAGLASNNKYSLIGSARATIQLLSFEVVSTLTILAPLMVVGSLSLVEINHYQSGGFLDWLVFKQPLAFVLFLIASYAELNRTPFDLLEHEAEIVAGYCTEYSGLKWGMFFLAEYAHLFAFSFVISIVFFGGFNAWGFIPGGIAILIKAGFFVFLSMWVRATYPHVRPDQLMDMCWKIMLPLALLNIVLTGIIILI

SEQ ID NO: 21 - DNA, 474 bp, Helicobacter pylori
  CDS (1)..(474)
gacgccaaggctcaagaagtggcgatgtgcgtagcgatgggtaaaaccctaaacgataaggggcgcttgaaacactccgtgcatgagttttacattaaatcccccgaagaaatggcaaagctctttgcagatattccagaagctttagaaaacacccaagaaatcgctgataaatgcgttttagagattgatttaaaagacgataaaaagaaccccccaacccccccaagcttcaaattcactaaagcttacgctcaaaatgaggggctgaattttgaagatgacgcttcttattttgcctataaggctagagaaggcttgaaagagcgcttagttttagtaccaaaagaaaagcatgatcaatataaagagcgcctagaaaaagaaattgaagtcattacgaacatgaaattcccagggtatatgctgattgtgtgggattttatccgttatgctaaggaaatgggcattcct

SEQ ID NO: 22 - protein, 158 aa, Helicobacter pylori
DAKAQEVAMCVAMGKTLNDKGRLKHSVHEFYIKSPEEMAKLFADIPEALENTQEIADKCVLEIDLKDDKKNPPTPPSFKFTKAYAQNEGLNFEDDASYFAYKAREGLKERLVLVPKEKHDQYKERLEKEIEVITNMKFPGYMLIVWDFIRYAKEMGIP

SEQ ID NO: 23 - DNA, 512 bp, Helicobacter pylori
  CDS (1)..(510)
aagaataaagcattccacaacattgcccttgatattgaaaccctaaaccaagaagccctaaaaaacacttatgatgtgagcgcaatcagctttgggttataccctaaaattgcgaacgattacgccttactccccacggcaacgagctttgggaatggctatgggcctaaattagtgaaaaaaaagggcgtgaaattgaaaaaagattttagagtcgcattaagtggggagcacaccaccaacgccctcttgtttaagatctattacaaacatgcgcgcatcacttatatgaattttttagacattgaaaaagcggttttggaagaaaaagtgcatgcgggcgtattgatccatgagagtatcttggattttcataatgaattagaagtggaaaaagaattgtgggatgtttggaaagaactcattgaagtggatttgcccttgcctttagggggcatggcgatcaggcgatctatccccttgtatcgcgcgattttgattaaaaaggcttt

SEQ ID NO: 24 - protein, 170 aa, Helicobacter pylori
KNKAFHNIALDIETLNQEALKNTYDVSAISFGLYPKIANDYALLPTATSFGNGYGPKLVKKKGVKLKKDFRVALSGEHTTNALLFKIYYKHARITYMNFLDIEKAVLEEKVHAGVLIHESILDFHNELEVEKELWDVWKELIEVDLPLPLGGMAIRRSIPLYRAILIKKA

SEQ ID NO: 25 - DNA, 432 bp, Helicobacter pylori
  CDS (1)..(432)
ttaaaaatcattcaaggggcattagatactagggagcttttaaaagcctaccaagaggaagcttgcgcgaaaaactttggagcgttttgtgtgtttgtggggattgtgagaaaagaggataacattcaaggcttgagttttgatatttatgaagcgctattaaagacttggtttgaaaaatggcaccataaagccaaagatttgggcgtggtgttaaaaatggcgcacagcctgggcgatgttttgataggacaaagctcatttttatgcgtttcaatgggaaagaatagaaaaaatgccttagaactatacgaaaattttattgaagattttaagcataacgctcctatttggaaatacgatttaatccataataaacgcatttatgctaaagaaagaagccaccctttaaaagggagcgggcttttagct

SEQ ID NO: 26 - protein, 144 aa, Helicobacter pylori
LKIIQGALDTRELLKAYQEEACAKNFGAFCVFVGIVRKEDNIQGLSFDIYEALLKTWFEKWHHKAKDLGVVLKMAHSLGDVLIGQSSFLCVSMGKNRKNALELYENFIEDFKHNAPIWKYDLIHNKRIYAKERSHPLKGSGLLA

SEQ ID NO: 27 - DNA, 516 bp, Helicobacter pylori
  CDS (1)..(516)
ttaagctttagcgcggataaattctttaacagtgcgcaagcgggcattattatggggcaaaaagaacgggttgaagcgttaaaaaaccaccccctttatagagttttaagggtgggtaaaatcacgctcaccttgcttttttgcagcctaaaagcatggataaatcatcaagaagacattacaatccatgcgttattgaaccaaactaaagacgcattattgcaaaaagccctcaaactctacgctcttttaaagcctttagaattgaatgtgagcatagcctctagcttttctaaaatagggaatttgtttggtagggaattagaatccttttgcgtgaaaatccagcccaaaaacacccgtgctttaaatagtgagaaactttatttaaagcttttccaaaaaggcgttatcgcaaggatttcatgcgaattcgtgtgctttgaagtctttagcttgaatgaaaaagattttgaaaaaatcgctctggttttagaagaaattcttaataaagct

SEQ ID NO: 28 - protein, 172 aa, Helicobacter pylori
LSFSADKFFNSAQAGIIMGQKERVEALKNHPLYRVLRVGKITLTLLFCSLKAWINHQEDITIHALLNQTKDALLQKALKLYALLKPLELNVSIASSFSKIGNLFGRELESFCVKIQPKNTRALNSEKLYLKLFQKGVIARISCEFVCFEVFSLNEKDFEKIALVLEEILNKA

SEQ ID NO: 29 - DNA, 444 bp, Helicobacter pylori
  CDS (1)..(444)
atcattactcaagctagaaaggctaatggggtgattgttctagccttacaagacattaaccaactaagcgaagtgagaaacgctcaaagctttataaaaaatatggggcaattgattttgtatccccaaagaaatattgataccaaagatttaaacgataaatttggcattagactaagcgatacagaaaaacattttttagaaaacaccgccgttaatgaatacaaagtcttactcaaaaacatgaatgatggctcatctaacattatagatgtgagcctaagttctttgggtaattacctacaaatctttagctctaattctagcatggtagaacacattgataatctcattaagcattaccctaaaacttggcgagaagtctttgtgagtaacaaacacgaaaattttgatgacaaaaaacacttagaaaaggtgcttaaa

SEQ ID NO: 30 - protein, 148 aa, Helicobacter pylori
IITQARKANGVIVLALQDINQLSEVRNAQSFIKNMGQLILYPQRNIDTKDLNDKFGIRLSDTEKHFLENTAVNEYKVLLKNMNDGSSNIIDVSLSSLGNYLQIFSSNSSMVEHIDNLIKHYPKTWREVFVSNKHENFDDKKHLEKVLK

SEQ ID NO: 31 - DNA, 426 bp, Helicobacter pylori
  CDS (1)..(426)
acggtgggcgatgtttttggtgaaaacgggcttttaaacgcgctagatcctacggaaagaaaaaaaattgatcaaatgcttttagagcaaatccaagcccattcttcagggtttgaaaaattcatcgtgaaaactttagggattgaaaatgtagagaatttcatcaataactggtatggcaagcaaagcttgagttcttttgccaataattttgtgcctggaggcttgaatcaagcccttgataaaataggctctagctctgatgccaaagacttacagaacttcttggataaaacgacttttggggatattttaaatcaaatgattgaacaagcccccttaatcaataaactcatttcttggctgggtccgcaggatttgagcgttttagtgaatatcgctttaaatagcatcactaaccctagt

SEQ ID NO: 32 - protein, 142 aa, Helicobacter pylori
TVGDVFGENGLLNALDPTERKKIDQMLLEQIQAHSSGFEKFIVKTLGIENVENFINNWYGKQSLSSFANNFVPGGLNQALDKIGSSSDAKDLQNFLDKTTFGDILNQMIEQAPLINKLISWLGPQDLSVLVNIALNSITNPS

SEQ ID NO: 33 - DNA, 357 bp, Helicobacter pylori
  CDS (1)..(357)
caagcgcaccatcttaaaaaccttttggaagccttttatcaccaaaataaagagagtttgggctttttttccccttattttagtttgcgatctcaaacccctagcgtctcttatgaaagcgcgttagcttctttagaaaactattttatggctttgttccaatcccattttaaagacgataccgcactccaacagaattttaaaggattgttgcaagcctttgtttctatggctaaagacaaacgatcccaaatcgctcttaacgcccaagctaaagacaacgccaagctaacttttaacgccttgttagaaagccttagcgtgaatttctttcaatcttacaaaataagccatgag

SEQ ID NO: 34 - protein, 119 aa, Helicobacter pylori
QAHHLKNLLEAFYHQNKESLGFFSPYFSLRSQTPSVSYESALASLENYFMALFQSHFKDDTALQQNFKGLLQAFVSMAKDKRSQIALNAQAKDNAKLTFNALLESLSVNFFQSYKISHE

SEQ ID NO: 35 - DNA, 980 bp, Helicobacter pylori
  CDS (1)..(978)
gtgggttctggagccgggaggaaagccagctctacggttttaactttgcaagcttcagaagggattactagcagtaaaaatgcggaaatttctctttatgatggcgccacgctcaatttggcttcaaacagcgttaaattaatgggtaatgtgtggatgggccgtttgcaatatgtgggagcgtatttggccccttcatacagcacgataaacacttcaaaagtgacaggggaagtgaattttaaccatctcactgtgggcgatcacaacgccgctcaagcaggcattatcgctagtaacaagactcatattggcacactggatttgtggcaaagcgcgggactaaacattatcgcccctccagaaggcggttataaggataaacctaaggataaacctagtaacaccacgcaaaataatgctaacaacaaccaacaaaacagcgctcaaaacaatagtaacactcaggttattaacccacccaatagcgcgcaaaaaacagaaattcaacccacgcaagtcattgatgggccttttgctggtggcaaagacacggttgtcaatattgatcgcatcaacactaacgctgatggcacgattaaagtgggagggtataaagcttctcttaccaccaatgcggctcatttgcatatcggcaaaggcggtatcaatctgtccaatcaagcgagcgggcgcacccttttagtggaaaatctaaccgggaatatcaccgttgatgggcctttaagagtgaataatcaagtgggtggttatgctttggcaggatcaagcgcgaattttgagtttaaggctggtacggataccaaaaacggcacagccacttttaataacgatattagtttgggaagatttgtgaatttaaaagtggatgctcatacagctaattttaaaggtattgatactggtaatggtggtttcaacaccttagattttagtggcgttacaggtaaggtcaatat

SEQ ID NO: 36 - protein, 326 aa, Helicobacter pylori
VGSGAGRKASSTVLTLQASEGITSSKNAEISLYDGATLNLASNSVKLMGNVWMGRLQYVGAYLAPSYSTINTSKVTGEVNFNHLTVGDHNAAQAGIIASNKTHIGTLDLWQSAGLNIIAPPEGGYKDKPKDKPSNTTQNNANNNQQNSAQNNSNTQVINPPNSAQKTEIQPTQVIDGPFAGGKDTVVNIDRINTNADGTIKVGGYKASLTTNAAHLHIGKGGINLSNQASGRTLLVENLTGNITVDGPLRVNNQVGGYALAGSSANFEFKAGTDTKNGTATFNNDISLGRFVNLKVDAHTANFKGIDTGNGGFNTLDFSGVTGKVN

SEQ ID NO: 37 - DNA, 362 bp, Helicobacter pylori
  CDS (1)..(360)
agtaatttatgtggtaatggtagtagcggtagtagtggcactacttgctccggttggcttatcaaccttttaggggcaatccccaccaatggagtgagcgatacgaataatttaattaatctgctcactgaattcattaaaaccgccgggtttatccaaaataatgatagtagtgtatctactagtcttacaagcgcttttcaagccattacgagcgctatttctcaagggtttcaagccttacaaaacgatattagccctaatgcgattttaaccttgctccaagagattacttctaacaccaccaccattcagtcattctcgcaaaccttacggcagcttttaggggataaaacattctt

SEQ ID NO: 38 - protein, 120 aa, Helicobacter pylori
SNLCGNGSSGSSGTTCSGWLINLLGAIPTNGVSDTNNLINLLTEFIKTAGFIQNNDSSVSTSLTSAFQAITSAISQGFQALQNDISPNAILTLLQEITSNTTTIQSFSQTLRQLLGDKTF

SEQ ID NO: 39 - DNA, 448 bp, Helicobacter pylori
  CDS (1)..(447)
ctctttgcagatattccagaagctttagaaaacacccaagaaatcgctgataaatgcgttttagagattgatttaaaagacgataaaaagaaccccccaacccccccaagcttcaaattcactaaagcttacgctcaaaatgaggggctgaattttgaagatgacgcttcttattttgcctataaggctagagaaggcttgaaagagcgcttagttttagtaccaaaagaaaagcatgatcaatataaagagcgcctagaaaaagaaattgaagtcattacgaacatgaaattcccagggtatatgctgattgtgtgggattttatccgttatgctaaggaaatgggcattcctgtagggcctggtagggggagtgcggccgggagcttggtggcttttgctttaaaaatcacggatattgaccctttgaaatacgatttgctctttg

SEQ ID NO: 40 - protein, 149 aa, Helicobacter pylori
LFADIPEALENTQEIADKCVLEIDLKDDKKNPPTPPSFKFTKAYAQNEGLNFEDDASYFAYKAREGLKERLVLVPKEKHDQYKERLEKEIEVITNMKFPGYMLIVWDFIRYAKEMGIPVGPGRGSAAGSLVAFALKITDIDPLKYDLLF

SEQ ID NO: 41 - DNA, 147 bp, Helicobacter pylori
  CDS (1)..(147)
caatacgactttaaggcgatgtttactcccttgatcatgcaagcgcagttgagcttaagaaacattgataattttgtggaaaaaggctctgctttgatagataaatttgacgctaacccctataaaacgatttttggagaaaggaaa

SEQ ID NO: 42 - protein, 49 aa, Helicobacter pylori
QYDFKAMFTPLIMQAQLSLRNIDNFVEKGSALIDKFDANPYKTIFGERK

SEQ ID NO: 43 - DNA, 455 bp, Helicobacter pylori
  CDS (1)..(453)
aatttcaattcagcgaatattactacgagtttgaataattcctctatcgtgtttaagggggcggtctctttaggagggcagtttaatttaagcaataactcttctttagatttccaaggctctagcgctatcacctctaacacggcgtttaatttctatgataacgctttttctcaaagccccatcactttccatcaagcccttgacattaaagcgcccttaagtttgggaggcaaccttttaaaccctaacaacagcagcgtgctggatttaaaaaacagccagcttgtttttggcgatcaagggagtttgaatatcgctaacattgatttactaagcgatctaaatgataataaaaatcgtgtgtataacatcattcaagcggacatgaatagtaattggtatgagcgtatcagcttctttggcatgcacatcaatgacgggatttatgatgc

SEQ ID NO: 44 - protein, 151 aa, Helicobacter pylori
NFNSANITTSLNNSSIVFKGAVSLGGQFNLSNNSSLDFQGSSAITSNTAFNFYDNAFSQSPITFHQALDIKAPLSLGGNLLNPNNSSVLDLKNSQLVFGDQGSLNIANIDLLSDLNDNKNRVYNIIQADMNSNWYERISFFGMHINDGIYD

SEQ ID NO: 45 - DNA, 333 bp, Helicobacter pylori
  CDS (1)..(333)
gattttagtttcaacgcacaaggcaatgtttttgtgcaaaattccactttctctaacgccaatggaggcacgctctcttttaacgcaggaaattcgctcatttttgccggaaacaatcatattgcattcactaaccacgctggaactcttcaattattgtccgatcaagtttctaacattaacatcaccacgcttaacgctagcaacggccttaagattaacgccgctaataacaatgtttctgtgtctcaaggcaatctgtttgtcagcgctagctgcgcgcaacaaagcgatccaactacagctaatattgcaaacccttgcgcgcttagc

SEQ ID NO: 46 - protein, 111 aa, Helicobacter pylori
DFSFNAQGNVFVQNSTFSNANGGTLSFNAGNSLIFAGNNHIAFTNHAGTLQLLSDQVSNINITTLNASNGLKINAANNNVSVSQGNLFVSASCAQQSDPTTANIANPCALS

SEQ ID NO: 47 - DNA, 674 bp, Helicobacter pylori
  CDS (1)..(672)
ttgcgcttgggccaattcaatggcaattctttcacaagctataaggatagcgctgatcgcaccacgagagtggatttcaacgctaaaaatatcttaattgataattttttagaaatcaataatcgtgtgggttctggagccgggaggaaagccagctctacggttttaactttgcaagcttcagaagggattactagcagtaaaaatgcggaaatttctctttatgatggcgccacgctcaatttggcttcaaacagcgttaaattaatgggtaatgtgtggatgggccgtttgcaatatgtgggagcgtatttggccccttcatacagcacgataaacacttcaaaagtgacaggggaagtgaattttaaccatctcactgtgggcgatcacaacgccgctcaagcaggcattatcgctagtaacaagactcatattggcacactggatttgtggcaaagcgcgggactaaacattatcgcccctccagaaggcggttataaggataaacctaaggataaacctagtaacaccacgcaaaataatgctaacaacaaccaacaaaacagcgctcaaaacaatagtaacactcaggttattaacccacccaatagcgcgcaaaaaacagaaattcaacccacgcaagtcattgatgggccttttgctggtggcaa

SEQ ID NO: 48 - protein, 224 aa, Helicobacter pylori
LRLGQFNGNSFTSYKDSADRTTRVDFNAKNILIDNFLEINNRVGSGAGRKASSTVLTLQASEGITSSKNAEISLYDGATLNLASNSVKLMGNVWMGRLQYVGAYLAPSYSTINTSKVTGEVNFNHLTVGDHNAAQAGIIASNKTHIGTLDLWQSAGLNIIAPPEGGYKDKPKDKPSNTTQNNANNNQQNSAQNNSNTQVINPPNSAQKTEIQPTQVIDGPFAGG

SEQ ID NO: 49 - DNA, 284 bp, Helicobacter pylori
  CDS (1)..(282)
agaggcttgcatgatttttggcaaaaagggtattttaactttttaagcaatggctatgtttttgtcaataacagctcttttagcaacgctacaggaggcagtttgaattttgtcgccaacaagtctattatttttaatggcgataatacgattgactttagcaagtatcagggcgcattgatttttgcttctaatgatgtttctaatatcaatatcaccaccctaaacgctactaatggcttaagccttaatgcgggtttgaataacgtgagcgttcaaaaagg

SEQ ID NO: 50 - protein, 94 aa, Helicobacter pylori
RGLHDFWQKGYFNFLSNGYVFVNNSSFSNATGGSLNFVANKSIIFNGDNTIDFSKYQGALIFASNDVSNINITTLNATNGLSLNAGLNNVSVQK

SEQ ID NO: 51 - DNA, 498 bp, Helicobacter pylori
  CDS (1)..(498)
aaaattttagtgattcaagggcctaatttaaacatgttaggacacagagacccaaggctttatggtatggtaaccttagaccaaatccatgaaatcatgcaaactttcgtgaaacaaggcaatttagatgtggaattagagttttttcaaactaattttgagggcgaaatcattgataaaatccaagagagcgtgggcagcgattatgaagggatcatcattaaccctggagcgttttcgcacacttctattgcgattgcagatgcgatcatgctagcgggcaaacccgttattgaagtgcatctcactaacattcaagccagagaggaattcaggaaaaattcttacactggagcggcttgtggaggcgtgatcatgggatttggcccgcttggctacaacatggctttaatggcgatggtcaatattttagccgaaatgaaagcgttccaagaagcccaaaaaaacaaccctaataaccccattaacaatcaaaaa

SEQ ID NO: 52 - protein, 166 aa, Helicobacter pylori
KILVIQGPNLNMLGHRDPRLYGMVTLDQIHEIMQTFVKQGNLDVELEFFQTNFEGEIIDKIQESVGSDYEGIIINPGAFSHTSIAIADAIMLAGKPVIEVHLTNIQAREEFRKNSYTGAACGGVIMGFGPLGYNMALMAMVNILAEMKAFQEAQKNNPNNPINNQK

SEQ ID NO: 53 - DNA, 75 bp, Helicobacter pylori
  CDS (1)..(75)
caatctttgataacaataataaatcggctaatgcaaaaacaggaccagcgactatcatcgctcaaggcacaaaaa

SEQ ID NO: 54 - protein, 25 aa, Helicobacter pylori
QSLITIINRLMQKQDQRLSSLKAQK

SEQ ID NO: 55 - DNA, 679 bp, Helicobacter pylori
  CDS (1)..(678)
tttaacaacagcgcttcttttaatttcaataattctaacgcgaccacttcgtttgtgggggatttcactaacgctaattcaaatttgcaaatcgccgggaacgctgtttttgggaactctactaatggctctcaaaataccgctaattttaataataccggctctgttaatatttcagggaatgcaacctttgataatgtggtgtttaatggccctacgaacacgagcgtgaaagggcaggttactttaaataacatcactttaaaaaacctgaacgcccctttgtcttttggcgatgggacgattacttttaacgctcattcggtgattaatattgctgaatctatcactaatggcaaccctatcactcttgtaagctcttctaaagaaattgaatacaacaacgctttcagtaaaaatctatggcagctcatcaactaccaagggcatggggcaagcagtgaaaagctcgtctctagcgcgggtaatggcgtttatgatgtggtgtattctttcaataaccaaacctacaatttccaagaggttttttcacaaaacagcatttctatccggcgtttgggcgttaacatggtgtttgattatgtggatatggaaaaatcggatcatttatattatcaaaacgctctcggttttatgacctacatgcctaatagctata

SEQ ID NO: 56 - protein, 226 aa, Helicobacter pylori
FNNSASFNFNNSNATTSFVGDFTNANSNLQIAGNAVFGNSTNGSQNTANFNNTGSVNISGNATFDNVVFNGPTNTSVKGQVTLNNITLKNLNAPLSFGDGTITFNAHSVINIAESITNGNPITLVSSSKEIEYNNAFSKNLWQLINYQGHGASSEKLVSSAGNGVYDVVYSFNNQTYNFQEVFSQNSISIRRLGVNMVFDYVDMEKSDHLYYQNALGFMTYMPNSY

SEQ ID NO: 57 - DNA, 750 bp, Helicobacter pylori
  CDS (1)..(750)
aacgccacgatcaacgattatgcgagcttgattgcgagtaatggctctcaccttaattttaacggggcggttaatttcaattcagcgaatattactacgagtttgaataattcctctatcgtgtttaagggggcggtctctttaggagggcagtttaatttaagcaataactcttctttagatttccaaggctctagcgctatcacctctaacacggcgtttaatttctatgataacgctttttctcaaagccccatcactttccatcaagcccttgacattaaagcgcccttaagtttgggaggcaaccttttaaaccctaacaacagcagcgtgctggatttaaaaaacagccagcttgtttttggcgatcaagggagtttgaatatcgctaacattgatttactaagcgatctaaatgataataaaaatcgtgtgtataacatcattcaagcggacatgaatagtaattggtatgagcgtatcagcttctttggcatgcacatcaatgacgggatttatgatgctaaaaaccaaacttatagtttcactaacccccttaataacgccctaaaaatcaccgagagctttaaagacaaccaactaagcgttacgctctctcaaatcccgggtattaaaaacacgctctataacattggctctgaaatttttaactaccaaaaagtttataacaacgctaatggcgtgtattcttatagcgatgatgcacaaggcgtgttttatctcaca

SEQ ID NO: 58 - protein, 250 aa, Helicobacter pylori
NATINDYASLIASNGSHLNFNGAVNFNSANITTSLNNSSIVFKGAVSLGGQFNLSNNSSLDFQGSSAITSNTAFNFYDNAFSQSPITFHQALDIKAPLSLGGNLLNPNNSSVLDLKNSQLVFGDQGSLNIANIDLLSDLNDNKNRVYNIIQADMNSNWYERISFFGMHINDGIYDAKNQTYSFTNPLNNALKITESFKDNQLSVTLSQIPGIKNTLYNIGSEIFNYQKVYNNANGVYSYSDDAQGVFYLT

SEQ ID NO: 59 - DNA, 989 bp, Helicobacter pylori
  CDS (1)..(987)
cttatcaatttcaaagggaatacgaattttaatcaagccacgctcaatttaagggctaaaaatatccatatcaatttccaaggcgtttctacttttaaacaaaactctacgatgaatttagctgaaagttcccaagcgagctttaacgctcttaaagtggaaggggaaacgaatttcaatctcaataactcaagcttgttgaatttcaatggcaatagcgttttcaacgctcctgtgagtttttatgctaatcattctcaaatttctttcactaaattagcgacttttaattctgacgcttcttttgatttaagcaacaacagcaccctgaattttcaaagcgttcttttaaatggtgctctaaaccttttaggcaatggcagtaacaatctagcgatcaacgctaaagggaattttagttttgggtctaaagggattttgaatctgtcttatatgaatctatttgggggggataaaaaaacttccgtttatgatgtgttgcaagcccaaaatattgatggcttaatggggaataacggctatgagaagatccgtttttatggcatacagattgacaaggctgattactcgtttgataacggcgttcattcttggagattcactaacccgctcaatacgactgaaacgattacagaaaccttgcataacaaccgcttgaaagtgcagatctctcaaaacggcgtttctaataataagatgttcaatctcgctcctagcttgtatgattaccaaaaaaacccttataatgaaaccgagaattcctataattacacaagcgataaggttggcacttattatttaacgagcaatatcaaaggctttaatcaaaacaataaaacacccgggacttataacgcgcaaaaccaacccttacaagccttacacatttacaatcaggctatcactaagcaagatttgaacatgatcgccagtttgggtaaggagtttttgcctaaaatagccaatct

SEQ ID NO: 60 - protein, 329 aa, Helicobacter pylori
LINFKGNTNFNQATLNLRAKNIHINFQGVSTFKQNSTMNLAESSQASFNALKVEGETNFNLNNSSLLNFNGNSVFNAPVSFYANHSQISFTKLATFNSDASFDLSNNSTLNFQSVLLNGALNLLGNGSNNLAINAKGNFSFGSKGILNLSYMNLFGGDKKTSVYDVLQAQNIDGLMGNNGYEKIRFYGIQIDKADYSFDNGVHSWRFTNPLNTTETITETLHNNRLKVQISQNGVSNNKMFNLAPSLYDYQKNPYNETENSYNYTSDKVGTYYLTSNIKGFNQNNKTPGTYNAQNQPLQALHIYNQAITKQDLNMIASLGKEFLPKIAN

SEQ ID NO: 61 - DNA, 357 bp, Helicobacter pylori
  CDS (1)..(357)
ttaatgcttaaagacacgcatttaaggcatgtgaaagatctcaaaagctttttaacgcatgccagaaaaaacttgcctttcacggctaaaattgaaattgaatgcgaaagctttgaagaggccaaaaacgccatgaatgcgggagcggatattgtgatgtgcgataatttgagcgttttagagactaaagaaattgccgcttatagagatgcgcattatccctttgttttactggaagcgagcgggaacatttcactagagagcattaacgcttacgctaaaagcggcgtggatgccattagcgtaggggctttaatccatcaagccacttttattgacatgcacatgaaaatggct

SEQ ID NO: 62 - protein, 119 aa, Helicobacter pylori
LMLKDTHLRHVKDLKSFLTHARKNLPFTAKIEIECESFEEAKNAMNAGADIVMCDNLSVLETKEIAAYRDAHYPFVLLEASGNISLESINAYAKSGVDAISVGALIHQATFIDMHMKMA

SEQ ID NO: 63 - DNA, 437 bp, Helicobacter pylori
  CDS (1)..(435)
gttggcaatctaagggatttaaaccccttggatttcagcgtggatcatgtggatttggaatggtttgaaacgaggaaaaaaatcgctcgttttaaaaccaggcaaggcaaagacatagccatacgccttaaagacgctcccaagttggggctctctcaaggggatattttatttaaagaagagaaggaaattatcgccgttaatatcttggattctgaagtcattcacatccaagccaagagcgtggcagaagtagcgaaaatatgctatgaaataggaaaccgccatgcggctttatactatggcgagtctcaatttgaatttaaaacaccatttgaaaagcccacgctagcgttattagaaaagctaggggttcaaaatcgtgttttaagttcaaaattggattccaaagaacgcttaaccgtgagcatgcccca

SEQ ID NO: 64 - protein, 145 aa, Helicobacter pylori
VGNLRDLNPLDFSVDHVDLEWFETRKKIARFKTRQGKDIAIRLKDAPKLGLSQGDILFKEEKEIIAVNILDSEVIHIQAKSVAEVAKICYEIGNRHAALYYGESQFEFKTPFEKPTLALLEKLGVQNRVLSSKLDSKERLTVSMP

SEQ ID NO: 65 - DNA, 831 bp, Helicobacter pylori
  CDS (1)..(831)
agcactggtgatgttagtgaacaaatagaactagaacaagaaaaacaaaagacgagcaatatagagactaacaatcaaataaaagtagaacaagaaaaacaaaagacaagcaatatagagactaataatcaaataaaagtagaacaagaacaacaaaagacaagcaatacacagaaagatttggttaaagaacagaaagatttggttaaagaacagaaagatttggttaaagaacagaaagatttggttaaagaacagaaagatttggttaaaacacagaaagatttcattaaatatgtagaacaaaattgccaagaaaatcataatcaattctttattgaaaaaggaggaattaaggctggtattggtatagaagtagaagctgaatgcaaaacccctaaacctgcaaaaaccaatcaaacccctatccagccaaaacacctcccaaactctaaacaaccccgctctcaaagaggatcaaaagcgcaagagcttatcgcttatttgcaaaaagagctagaatttctgccctattcgcaaaaagctatcgctaaacaagtggatttttacaggccaagttctatcgcttatttagaactagatcctagagattttaaggttacagaagaatggcaaaaagaaaatctaaaaatacgctctaaagctcaagctaaaatgcttgaaatgagaaacccacaagcccacctttcaaactctcaaagccttttgttcgttcaaaaaatatttgctgatgttaataaagaaatagaagcagttgctaatactgaaaagaaagcagaaaaagcgggttatggttatagtaaaaggatg

SEQ ID NO: 66 - protein, 277 aa, Helicobacter pylori
STGDVSEQIELEQEKQKTSNIETNNQIKVEQEKQKTSNIETNNQIKVEQEQQKTSNTQKDLVKEQKDLVKEQKDLVKEQKDLVKEQKDLVKTQKDFIKYVEQNCQENHNQFFIEKGGIKAGIGIEVEAECKTPKPAKTNQTPIQPKHLPNSKQPRSQRGSKAQELIAYLQKELEFLPYSQKAIAKQVDFYRPSSIAYLELDPRDFKVTEEWQKENLKIRSKAQAKMLEMRNPQAHLSNSQSLLFVQKIFADVNKEIEAVANTEKKAEKAGYGYSKRM

SEQ ID NO: 67 - DNA, 915 bp, Helicobacter pylori
  CDS (1)..(915)
aaagaatggattgttgcatttgatgaagacgcccctaaatttgaagctagtggggaatattgcgtgagcacggatagttttgtcatcacgcccttaatttttaatgggggcgatataggcaagctttgcgtttgcgggagtgcgaatgatgtgagcgtgcaagggggcgaacctttgtatttgaatatgggttttattttagaagaaggcttagaaatttctcttttaaaacaaattttacaatccatacaaaaagaattgtttaaagccaacctgaaactcctctccctagacactaaagtcgtgccaaaggggagcgtggataagctttttatcaacacaacctgcattggtaaaatcatcaagccagggatttcttcgtaccatttacaacaagggcaagccattatcctaagcgacactatcgccaatcatggggcaagcttatttgcgatgcgtaatgaaatcaagcttaaaacgaatctagaaagcgattgccaactgctctatcccttattaaaacccctatttttaagcgatctcaaaattgatgctttaagagatgcgactaggggcgggttagcgagcgtgctgaacgaatgggcgaacagctctagagtgaaaatcgttatagaagaagaaaaaatccccttaaaagaagaaacgaaagggatttgtgagattttagggttagaaccctacgcgctagccaatgagggggtgtttgttttagcgctcaatcaaaaagacgcccctaaagccttagaaattttaaaaagtaacgaaaaagctaaaaacgcttgcgtgattggcaaagtgtttgaaaacccttatcctagcgtggttttaaagaacgcatggggttttgaaaggattttagaggtgccagagggcgaattattgcctaggatttgt

SEQ ID NO: 68 - protein, 305 aa, Helicobacter pylori
KEWIVAFDEDAPKFEASGEYCVSTDSFVITPLIFNGGDIGKLCVCGSANDVSVQGGEPLYLNMGFILEEGLEISLLKQILQSIQKELFKANLKLLSLDTKVVPKGSVDKLFINTTCIGKIIKPGISSYHLQQGQAIILSDTIANHGASLFAMRNEIKLKTNLESDCQLLYPLLKPLFLSDLKIDALRDATRGGLASVLNEWANSSRVKIVIEEEKIPLKEETKGICEILGLEPYALANEGVFVLALNQKDAPKALEILKSNEKAKNACVIGKVFENPYPSVVLKNAWGFERILEVPEGELLPRIC

SEQ ID NO: 69 - DNA, 1977 bp, Helicobacter pylori
  CDS (1)..(1977)
ttgaatttgctcagccaaatccctaaagatttaggcgtgtgcaaggattgcttgagagaaatcagggataaaaactccccctattttcattacgctttcaattcttgcgcgaagtgtggggcgagatacagccttttaaacgctttgccctatgacagagaaaactccgccctaaaacccttcaaactctgcgatttttgtgcttctatctatcaagaccccaccaataagcgcttccacattcaaggcatcagctgcaaaaagtgcggtatcgcgctcaattacaagcgattcaaaaacgatgacgctcttttagaatgcgctaaagacattcaaaagggtaaaatcatcgctcttaaaggtttgggaggctttgctctcttgtgcgatggaaggaattttcaaaccatagaaagattacggcttttaaaaaaccgccccctaaagcctttcgcactcatgtttaaagatttgaacacagccaaacagcatgcgtttttgaacgcgttagaatgcgagagcttaatttctacaagcgcccccattcttttagcgcgtaaaaaacctgatataaaattagcccccaatatcgctaaaaactcccccttttatggcgtgattttgccctatacccctttgcatgctttattgctggatttattggatttccctattgtgttcacgagcgcgaatttcagctccctccctttagcgagcgatgaggctgagattgacgccttgagtttcatttttgattttaagctcacgcacaaccgcgctatcatccataggattgatgacagcatcgtgcagcatgtggataatgccattcgccccatgcgtttggctagggggtttgcccccctttacctcaccttgcctaaacgctctaatggttcgccaaaaaagattttagcgcttggagcgcaacaaaaagggcattttagcttattggatagcggaacttccattcttttactctcgcctttttgtggggatttgagcgttttagaaaatgaaaaacactttaaagaaactttgaattttttcttaaaaacctatgattttaaacccaccatcttagcttgcgacaagcatcaaaactacaccaccactcaaatggcttttgattttaatacgcccttgttgcaagtccagcaccaccatgcccactttttagcgagcgtcttagacgcattgttacaagatccgcatttaaatcacccctttataggcattgtctgggatgggagtggggcttatgaaaataagatttatggggcggagtgttttgtgggggatttggaacgcattgaagaaaccgccaggtttgaagaattttggcttttaggggggcaaaaagcgatcaaagagcctagacgcctggttttagaaatcgctttaaaacaccaactcaacaagcttttaaagcgcgttcaaaagcattttaaagaagacgaattagaaattttccaacaaatgcatgacaaaaaaattcaaagcatagccaccaattccatagggcgtttgtttgatatagtagcgtttagtttggatttaacaggaacgattagctttgaagcagagagcgggcaggttttagaaaatctagccttacaaagcgatgagatcgctttttacccttttgaaatcaaaaacagcgtggtgtgtttgaaagaattttatcaagcgtttgaaaaggatttgggcgttttagagcctgaacgcatcgctaagaaattttttaacagcctagtagaaatcattaccgctttaatcgtgccttttaaagagcatgtggtggtgtgcagtgggggcgtgttttgcaaccaattattatgcgaacaattagccaaacgattgagagggctaaagaggcagtattttttccacaagcatttcccccctaatgacagcagtatccctatcggtcaagccttaatggcgtatttcaaccctacaatcatcaaaaaagga

SEQ ID NO: 70 - protein, 659 aa, Helicobacter pylori
LNLLSQIPKDLGVCKDCLREIRDKNSPYFHYAFNSCAKCGARYSLLNALPYDRENSALKPFKLCDFCASIYQDPTNKRFHIQGISCKKCGIALNYKRFKNDDALLECAKDIQKGKIIALKGLGGFALLCDGRNFQTIERLRLLKNRPLKPFALMFKDLNTAKQHAFLNALECESLISTSAPILLARKKPDIKLAPNIAKNSPFYGVILPYTPLHALLLDLLDFPIVFTSANFSSLPLASDEAEIDALSFIFDFKLTHNRAIIHRIDDSIVQHVDNAIRPMRLARGFAPLYLTLPKRSNGSPKKILALGAQQKGHFSLLDSGTSILLLSPFCGDLSVLENEKHFKETLNFFLKTYDFKPTILACDKHQNYTTTQMAFDFNTPLLQVQHHHAHFLASVLDALLQDPHLNHPFIGIVWDGSGAYENKIYGAECFVGDLERIEETARFEEFWLLGGQKAIKEPRRLVLEIALKHQLNKLLKRVQKHFKEDELEIFQQMHDKKIQSIATNSIGRLFDIVAFSLDLTGTISFEAESGQVLENLALQSDEIAFYPFEIKNSVVCLKEFYQAFEKDLGVLEPERIAKKFFNSLVEIITALIVPFKEHVVVCSGGVFCNQLLCEQLAKRLRGLKRQYFFHKHFPPNDSSIPIGQALMAYFNPTIIKKG

SEQ ID NO: 71 - DNA, 234 bp, Helicobacter pylori
  CDS (1)..(234)
gttgaaaaagagcatggtgctacgcccccaaaagaagccaaaataggcgttagaaaattctatcggcataaaaaatgggtggatgcagatgtgtggcaaatggaaaaattactgcctggaaatgaagtcataggacctgcgatcgtggaatcagatgcgaccactttcgtgatacccaaaggctttgcgacaagactagacaaacaccgattgttccacttgaaagaaattaaa

SEQ ID NO: 72 - protein, 78 aa, Helicobacter pylori
VEKEHGATPPKEAKIGVRKFYRHKKWVDADVWQMEKLLPGNEVIGPAIVESDATTFVIPKGFATRLDKHRLFHLKEIK

SEQ ID NO: 73 - DNA, 383 bp, Helicobacter pylori
  CDS (1)..(381)
ttgctctatagtgaaatcattgtcgcagggcgagtggcgcgcaatgagttgtttaaattcaaccgcttgcacaccaaaatctctattttacaagatgagaaacccatctattatgacaacacgattttagatcccaaaaccaccgacttaaataacatgtgcatgtttgatggctatacgcattatttgaatttggtgcttgtcaattgccccatagagctctctggtgtgcgagaatgcattgaagaaagcgaaggggtggatggggcagtgagtgaaaccgctagttctcatttatgcgtgaaagctttagcgaaaggctcagaacccttattgcatttaagagaaaaaatcgctcgcttggttacgcaaaccaccacgca

SEQ ID NO: 74 - protein, 127 aa, Helicobacter pylori
LLYSEIIVAGRVARNELFKFNRLHTKISILQDEKPIYYDNTILDPKTTDLNNMCMFDGYTHYLNLVLVNCPIELSGVRECIEESEGVDGAVSETASSHLCVKALAKGSEPLLHLREKIARLVTQTTT

SEQ ID NO: 75 - DNA, 165 bp, Helicobacter pylori
  CDS (1)..(165)
aaagaattgttaaacaaccacttcaaacaacgcctggcctttaggtgtaatggtgagaacttgagcgctatcaaaaaagatttacctctattaacaaacgaactcaacgcgctatttgtagagctttctaaagacagccatactgaattcaggcctttcagctta

SEQ ID NO: 76 - protein, 55 aa, Helicobacter pylori
KELLNNHFKQRLAFRCNGENLSAIKKDLPLLTNELNALFVELSKDSHTEFRPFSL

SEQ ID NO: 77 - DNA, 854 bp, Helicobacter pylori
  CDS (1)..(852)
acttctttaaacaagctcatttacacagggcaaatcattcctgataggggttcgtggttgtattttgaatacgattctaaagatgttttatacgctcgtatcaataaacgccgtaaagtgcctgttaccattttattcagggcgatggattatcaaaaacaagacatcatcaaaatgttctacccgcttgttaaagtgcgttatgaaaacgataaatatttgatcccgtttgcttcattagacgccaatcaaagaatggaatttgacttgaaagatcctcaaggcaaggttattcttttagcgggtaaaaagctcacttcaagaaagattaaagagcttaaagaaaaccatttagaatgggtggaataccctatggatattttactcaatcgccatttagctgagcctgttatggtagggaaagaagtcttattggacatgctcactcagctagataaaaacaaattagaaaaaatccacgatttaggcgtgcaagaatttgtgatcatcaacgatctggcgttagggcatgacgcttccattatccaatctttttcagccgattctgagtctttgaaattactcaagcaaaccgaaaaaattgatgatgaaaacgctctagcggcgattcgtatccataaggttatgaaaccaggcgatcccgttacgactgaagtggctaagcagtttgtcaaaaaacttttctttgatccagaacgctatgatttgaccatggtgggccgcatgaaaatgaatcacaagttaggcttgcatgtgcctgattacattacgactttaacgcatgaagatattatcaccaccgttaaatacctcatgaagatcaaaaacaatca

SEQ ID NO: 78 - protein, 284 aa, Helicobacter pylori
TSLNKLIYTGQIIPDRGSWLYFEYDSKDVLYARINKRRKVPVTILFRAMDYQKQDIIKMFYPLVKVRYENDKYLIPFASLDANQRMEFDLKDPQGKVILLAGKKLTSRKIKELKENHLEWVEYPMDILLNRHLAEPVMVGKEVLLDMLTQLDKNKLEKIHDLGVQEFVIINDLALGHDASIIQSFSADSESLKLLKQTEKIDDENALAAIRIHKVMKPGDPVTTEVAKQFVKKLFFDPERYDLTMVGRMKMNHKLGLHVPDYITTLTHEDIITTVKYLMKIKNN

SEQ ID NO: 79 - DNA, 1843 bp, Helicobacter pylori
  CDS (1)..(1842)
agaagcgacgctcccattgtaggcacggggattgaaaaaattattgctagggattcttggggagcgatcaaagccaatcgcgcaggcgttgtagaaaaaattgattctaaaaatatttatattttaggcgaaagcaaagaagaagcctatattgatgcgtattctttgcaaaaaaacttgcgcaccaaccaaaacaccagtttcaatcaagtccctatcgttaaagtgggcgataaagtgggagccgggcaaatcatcgctgatggccctagcatggatagaggcgagttggcgttagggaaaaatgtgcgcgtggcgttcatgccttggaatggctataactttgaagacgcgatcgtggtgagtgagtgcatcactaaagatgatattttcacttccacccacatttatgaaaaagaagtggatgctagggagcttaagcatggtgtggaagaatttaccgctgatattcctgatgtgaaagaagaagcgctcgctcatcttgatgaaagcgggatcgttaaagtcggtacttatgtgagcgctggcatgattttggtgggcaaaacttctcctaaaggcgagattaaaagcacgcctgaagagcggcttttaagggctatttttggggataaagccgggcatgtggtcaataagagtttgtattgccctcccagtttggaaggcacggtgattgatgtgaaagtcttcactaaaaaaggctatgagaaagacgcgcgagttttgagcgcgtatgaagaagaaaaagccaagcttgatatggagcattttgatcgcttgaccatgctcaatagagaagaattgttgcgcgttagctcgctcctttctcaagcgattttagaagagcctttcagccataacggcaaggattataaagaaggcgatcaaatccctaaagaagaaatcgcttcaatcaaccgcttcactttggctagtttggtcaaaaagtattctaaagaagtgcaaaaccactatgaaatcactaaaaacaatttcttagagcaaaagaaagttttgggcgaagagcatgaagaaaagctttctattttagaaaaagatgatattttgcctaatggcgtgatcaaaaaagtcaagctctatatcgctacaaaacgaaagcttaaagtgggcgataaaatggcaggaaggcatgggaataaagggattgtgtctaatatcgtgccggttgcggatatgccttataccgctgatggcgagcctgtagatattgttttaaaccctttaggcgtgccaagccgcatgaatatcgggcagattttagaaatgcatttaggcttagtggggaaagaatttgggaagcaaatcgctcgcatgctagaggataaaaccaaagattttgccaaagaattgcgtgctaaaatgctagaaatcgctaacgctattaatgaaaaagaccccttgacaatccatgcgcttgagaattgttctgatgaagagcttttggaatacgcaaaagattggagcaagggcgttaagatggctatccctgtgtttgaaggcatctcgcaagaaaaattttataagctatttgaattagctaagatcgctatggatggcaaaatggatctgtatgacggacgcacaggcgagaaaatgagggagcgcgtgaatgtgggctacatgtatatgatcaaactccaccatttagtggatgaaaaagtccatgccagaagcacaggcccttatagcttagtaacgcaccagcccgtggggggtaaagcgctctttgggggtcaaaggtttggggaaatggaagtgtgggccttggaagcttatggcgcagcgcacactctaaaagaaa

SEQ ID NO: 80 - protein, 614 aa, Helicobacter pylori
RSDAPIVGTGIEKIIARDSWGAIKANRAGVVEKIDSKNIYILGESKEEAYIDAYSLQKNLRTNQNTSFNQVPIVKVGDKVGAGQIIADGPSMDRGELALGKNVRVAFMPWNGYNFEDAIVVSECITKDDIFTSTHIYEKEVDARELKHGVEEFTADIPDVKEEALAHLDESGIVKVGTYVSAGMILVGKTSPKGEIKSTPEERLLRAIFGDKAGHVVNKSLYCPPSLEGTVIDVKVFTKKGYEKDARVLSAYEEEKAKLDMEHFDRLTMLNREELLRVSSLLSQAILEEPFSHNGKDYKEGDQIPKEEIASINRFTLASLVKKYSKEVQNHYEITKNNFLEQKKVLGEEHEEKLSILEKDDILPNGVIKKVKLYIATKRKLKVGDKMAGRHGNKGIVSNIVPVADMPYTADGEPVDIVLNPLGVPSRMNIGQILEMHLGLVGKEFGKQIARMLEDKTKDFAKELRAKMLEIANAINEKDPLTIHALENCSDEELLEYAKDWSKGVKMAIPVFEGISQEKFYKLFELAKIAMDGKMDLYDGRTGEKMRERVNVGYMYMIKLHHLVDEKVHARSTGPYSLVTHQPVGGKALFGGQRFGEMEVWALEAYGAAHTLKE

SEQ ID NO: 81 - DNA, 1040 bp, Helicobacter pylori
  CDS (1)..(1038)
ataaaaatgattgatgtgaatggtttattaaaagaactggatgatgccttagataaagttgttgctaaaaaagagccagagagttttctcaagccgatcatctcaccaatagaggactaccaaaagagtgtcaggcaaattcaagcgcaattcacagacgcgccaaagttcaatgaagagggcgcttacccacaatttttaagctgtggtttattggaaattaaaggcaagaatggcgctagcatggaattttgcttgcctaaagtttatcctttcccccctaaaagcttgtatatagagcatgaaaaagacgggcagtttttaagagaaatgctcatgcgcttgctatccagtgcgcctttagtgcaattagaagtgatcttagttgatgcgctgagcctagggggcattttcaatctggcaagaaggcttttacataaagacaatgactttatttaccagcaaaggattttaactgaaagcaaggaaatagaagaagccctaaagcatttgtatgaatatttaaaggttaatttgcaagaaaaattagccggttataaagattttgcgcattataatgaagaaaaaaaagaccgcttgcctttaaaagcgctttttttaagcggtgtagatgctttaagtcaaaacgcgctttattatctggaaaaaatcatgcgttttggctctaaaaatggggttttgagctttgtcaatttggagagtgaaaaaaataataaatccacagaagatttgaaacgctatgcggagtgttttaaagacaggacaagttttgaacgcttaaaatatcttaatatagaagtgatcaatgatcatggtatccaatctaagcacatgaaagacttcgctgataaaattaaagcgtattacgagaaaaagaaagcagttaaaagggagttgaaagacttacaaaaagacgaaaaattttggactgaaagctctcagtttaaagtgtctgtgccggtggggtgggatattaaccataaggaagtgtgttttgaaatcggtaacgaacaaaacca

SEQ ID NO: 82 - protein, 346 aa, Helicobacter pylori
IKMIDVNGLLKELDDALDKVVAKKEPESFLKPIISPIEDYQKSVRQIQAQFTDAPKFNEEGAYPQFLSCGLLEIKGKNGASMEFCLPKVYPFPPKSLYIEHEKDGQFLREMLMRLLSSAPLVQLEVILVDALSLGGIFNLARRLLHKDNDFIYQQRILTESKEIEEALKHLYEYLKVNLQEKLAGYKDFAHYNEEKKDRLPLKALFLSGVDALSQNALYYLEKIMRFGSKNGVLSFVNLESEKNNKSTEDLKRYAECFKDRTSFERLKYLNIEVINDHGIQSKHMKDFADKIKAYYEKKKAVKRELKDLQKDEKFWTESSQFKVSVPVGWDINHKEVCFEIGNEQN

SEQ ID NO: 83 - DNA, 63 bp, Helicobacter pylori
  CDS (1)..(63)
ataaaacccaccgaacaaaaaggtttttttaaaagtttccttgataagatttctaaattcttt

SEQ ID NO: 84 - protein, 21 aa, Helicobacter pylori
IKPTEQKGFFKSFLDKISKFF

SEQ ID NO: 85 - DNA, 846 bp, Helicobacter pylori
  CDS (1)..(846)
gtgttcaaagacagcaaaaaagacgcttgcgggttcatctatgagatcagcgagttcatgaaagcctataccgcattgctaaaaaaacaagaccgatacgtctatttattgaggtatctcccctctaggtattgggccagcattttaacgactgccctttatgtcaaataccctgattttgacgctttgaaaaagcttttggtgtcttattattaccaaacttggattgcaggaggcacgatcacgcgcatcaagcaaaccagtatcaacattatcaaaaacgttaaaagcaataagagcgttgaaaccatcaaagagcttatattgaatagcatcgactcttataacacctttgatcaatacctctataacttatgggatagctcttctgtttatcatagcaaatgggtgcgtcctgtcttagccctagctaattatttcatggcagatgaagagaaaccccattttatcgctatggatgccgaaacccaagtggagcatattttgccacaaacgcccaaaagaggcagtcaatggaacgcggattttgacaaagaaaaaagagaagaatgggtaaataatatcgcgaatttaacccttttaaagcgtaaaaagaacgcgcatgctttaaacggggattttgatgaaaaaagaaaaatttatggaggcaaagacacgagcaaagtgattagctgttatgacatcactaaagaattgtatagcaattataggaagtggaatgagaagtccctccaagagcgatacaaatctttgtataacactatcacgcctgttttacacatagaggggcaagaagatgattttgaagatgattttgatctagaa

SEQ ID NO: 86 - protein, 282 aa, Helicobacter pylori
VFKDSKKDACGFIYEISEFMKAYTALLKKQDRYVYLLRYLPSRYWASILTTALYVKYPDFDALKKLLVSYYYQTWIAGGTITRIKQTSINIIKNVKSNKSVETIKELILNSIDSYNTFDQYLYNLWDSSSVYHSKWVRPVLALANYFMADEEKPHFIAMDAETQVEHILPQTPKRGSQWNADFDKEKREEWVNNIANLTLLKRKKNAHALNGDFDEKRKIYGGKDTSKVISCYDITKELYSNYRKWNEKSLQERYKSLYNTITPVLHIEGQEDDFEDDFDLE

SEQ ID NO: 87 - DNA, 334 bp, Helicobacter pylori
  CDS (1)..(333)
tatggcgagtttttagaaaaagaaaaagagggctttatggtagatgagcaaaacccttatccggaagaagtccgctttaatgagttgcgtttagcggaatttgagagcgtttttagcgccattgtgcctttagaggatttagataaacctgcatgcgctcatcatgccctaaaggctttagaagccacgcttaaaaatagggatttgggctttgatgcgacagaattggaacagatcgcaaaaggtttcattcctaaggggtatttgtggcattttgacgcgaatgttttagggaatgtggcgttggtgagagaagagttattattaggcgtga

SEQ ID NO: 88 - protein, 111 aa, Helicobacter pylori
YGEFLEKEKEGFMVDEQNPYPEEVRFNELRLAEFESVFSAIVPLEDLDKPACAHHALKALEATLKNRDLGFDATELEQIAKGFIPKGYLWHFDANVLGNVALVREELLLGV

SEQ ID NO: 89 - DNA, 1692 bp, Helicobacter pylori
  CDS (1)..(1692)
ttagtcagctcttcagaatacgctaaaaaactcaatgcgattgacaagattaaaaaaaccgaagaaaagcaaaaagttttagatgaagaattagaagatggctatgactttttgaaagaaaaggattttttagagtggagcagaagcgatagcccagtgcgcatgtatttgcgcgaaatgggggatataaaacttttaagcaaagatgaagagattgaattgagcaagcaaatccgcttgggtgaagacattattttagacgcgatctgctcggtgccgtatttgattgattttatctatgcgtataaagacgctttaatcaatcgtgaaagaagggttaaagagcttttcaggagctttgatgatgacgatgaaaatagcgtgagcgattctaaaaaagatgaagacaacgaagaagatgaagaaaacgaagaaaggaaaaaagtcgtttctgaaaaagacaagaagcgtgtagaaaaggttcaagaaagctttaaagccctagacaaggctaaaaaagaatggcttaaagcccttgaagcccccatagatgaaagagaagacgaattggtgcgttcattgaccctagcttacaaacgccaaacactcaaagacagactctatgatttagaacctaccagcaaactgattaatgaattagtcaaaacgatggaaaccactttaaaaagcggcgatgggtttgaaaaagagttgaaacgcttggaatacaaactgcccttattcaatgacactctcatcgcaaaccataaaaaaatccttgccaatatcactaacatgactaaagaagatattatcgctcaagtgccagaagcgactatggtgagcgtgtatatggatcttaaaaagctttttttgactaaagaagcgagcgaagaaggctttgatctagcccccaacaagctaaaagaaattttagagcaaatcaaaagagggaagttgatttccgatcgcgctaaaaacaaaatggctaaatccaatttaaggttggtggtgagcatcgctaaacgattcacgagcagaggcttaccattcttggatttgattcaagagggcaatattggcttgatgaaagcggtggataagtttgagcatgaaaagggcttcaagttttctacctatgcgacctggtggatcaaacaagctatcagcagagccatagccgatcaggcccgcactatccgcatccccattcacatgattgatacgattaatcgcatcaataaagtcatgcgcaaacacattcaagaaaacggcaaagagcctgatttagaagtggtggctgaagaagtggggctttcgttagataaagtgaagaatgtgattaaggtgactaaagagcctatcagtttggaaaccccagtcggcaatgatgatgatggcaagtttggggatttcgtggaagataagaatatcgtcagctccattgatcacatcatgcgagaagatttgaaagcacaaattgaaagcgttttggatcagttgaatgagcgagaaaaagcggtgatccgcatgcgttttgggcttttagacgatgaaagcgatcgaactttagaagaaattggcaaggaattgaatgttactagagaaagggtgcgccagattgaaagctctgcgattaaaaaattgagaagcccgcagtacgggcgcattttaagaaactatttgcgcatt

SEQ ID NO: 90 - protein, 564 aa, Helicobacter pylori
LVSSSEYAKKLNAIDKIKKTEEKQKVLDEELEDGYDFLKEKDFLEWSRSDSPVRMYLREMGDIKLLSKDEEIELSKQIRLGEDIILDAICSVPYLIDFIYAYKDALINRERRVKELFRSFDDDDENSVSDSKKDEDNEEDEENEERKKVVSEKDKKRVEKVQESFKALDKAKKEWLKALEAPIDEREDELVRSLTLAYKRQTLKDRLYDLEPTSKLINELVKTMETTLKSGDGFEKELKRLEYKLPLFNDTLIANHKKILANITNMTKEDIIAQVPEATMVSVYMDLKKLFLTKEASEEGFDLAPNKLKEILEQIKRGKLISDRAKNKMAKSNLRLVVSIAKRFTSRGLPFLDLIQEGNIGLMKAVDKFEHEKGFKFSTYATWWIKQAISRAIADQARTIRIPIHMIDTINRINKVMRKHIQENGKEPDLEVVAEEVGLSLDKVKNVIKVTKEPISLETPVGNDDDGKFGDFVEDKNIVSSIDHIMREDLKAQIESVLDQLNEREKAVIRMRFGLLDDESDRTLEEIGKELNVTRERVRQIESSAIKKLRSPQYGRILRNYLRI

SEQ ID NO: 91 - DNA, 237 bp, Helicobacter pylori
  CDS (1)..(237)
aaactagttttagccaagaatacaagaaaatcagacgctaagagcgtggaattagaggatttgtatcacgaattcagtgaagataagcgttctattttctattttgcccccacaaacgcccacaaagacatgctcaaagcggtggattttttcaaagaaaaaggtcatacggcttatttagatgaggtgagggtcagcactgatgaaaaagattttctttatgaattgcacattatt

SEQ ID NO: 92 - protein, 79 aa, Helicobacter pylori
KLVLAKNTRKSDAKSVELEDLYHEFSEDKRSIFYFAPTNAHKDMLKAVDFFKEKGHTAYLDEVRVSTDEKDFLYELHII

SEQ ID NO: 93 - DNA, 444 bp, Helicobacter pylori
  CDS (1)..(444)
gaaggggttttaagggttttactcaataaaaagggcaagctcattaaagaatacaaaaccttagagcctttaaaaagcctagaaatccgtttgagtgaagcccccattgataaacgcaatgattttttataccataagaccacttatgcccctttttatcaaaaggctcgagcgctcattaaaaagggcgttatgtttgatgaaatcttttataaccaggatttggaactcactgagggcgctaggagcaatcttgttttagaaatccataacaggcttttaaccccttattttagcgcgggcgcgttaaacgggacgggtgttgtggggttgttaaaaaagggtcttgttgggcatgcacctttgaaattgcaagatttgcaaaaagcgtctaaaatctattgtattaacgcgctatatggcttagtggaagtgaaaataaaa

SEQ ID NO: 94 - protein, 148 aa, Helicobacter pylori
EGVLRVLLNKKGKLIKEYKTLEPLKSLEIRLSEAPIDKRNDFLYHKTTYAPFYQKARALIKKGVMFDEIFYNQDLELTEGARSNLVLEIHNRLLTPYFSAGALNGTGVVGLLKKGLVGHAPLKLQDLQKASKIYCINALYGLVEVKIK

SEQ ID NO: 95 - DNA, 719 bp, Helicobacter pylori
  CDS (1)..(717)
gcagatgaaacgaacgctctgagacaaaaaaacagagaactgaacaaaaaaatagattggcaaaaagattatgacagggaaaaattagaacgagataatagggatttagaacaatgcaaagaggatttattagccgctaacgagaatctaagaaatagaatccaagaatgggaaaatgaaaaaaacaagcttgatccaagagatgaaagaataaaagagttagaagaagaaaaaagggaattagagggaattttagcccaaaaagagaacgcagaacaaaaatataacactctttcagtcaaaaataagcaattagaagctgagttagatatgcttaacgaaaaatttgaaaaactgaaaaatatgtatgctggggtagaggattttgaaaaacgccaaaaaaatatcaaagaacaaattgtaaaaaccaaccccaaagtcttaggcgcaccttcaaacgaagtggaagaattagcgttcttagagcgtatagaaaagggcatgcaagagttcaatgttttctatcccaagcgtttattgtatatgttccacaccgctttaaaaagcacgtctctatcgccattgagcgtgctaagtggggtgagtgggacaggaaaatctgaactgcccaagctctatgtgcattttggggggttaaattttttaagcattgctgtgcagcctacttgggatagcccagaatcgttgatggggtattt

SEQ ID NO: 96 - protein, 239 aa, Helicobacter pylori
ADETNALRQKNRELNKKIDWQKDYDREKLERDNRDLEQCKEDLLAANENLRNRIQEWENEKNKLDPRDERIKELEEEKRELEGILAQKENAEQKYNTLSVKNKQLEAELDMLNEKFEKLKNMYAGVEDFEKRQKNIKEQIVKTNPKVLGAPSNEVEELAFLERIEKGMQEFNVFYPKRLLYMFHTALKSTSLSPLSVLSGVSGTGKSELPKLYVHFGGLNFLSIAVQPTWDSPESLMGY

SEQ ID NO: 97 - DNA, 819 bp, Helicobacter pylori
  CDS (1)..(819)
aatggggtggagattgtagggttggagcatttggataaagtgatttatttagatcaagcccccataggcaaaaccccacgaagcaaccctgccacttacacgggagtgatggatgaaatcaggattttatttgccgagcaaaaagaagctaaaattttaggctatagtgcgagccgttttagctttaatgttaaaggagggcggtgcgagaaatgccaaggcgatggggacattaaaatagaaatgcactttttgcctgatgtgttagtccaatgcgatagctgtaagggcgctaaatacaacccccaaactttagaaatcaaggtgaaaggcaaatccattgccgatgtgttgaacatgagcgtggaagaggcttatgaattttttgctaaattccctaaaatcgccgtgaagttaaaaacgcttatggatgtgggcttaggctatatcactttagggcaaaacgctacgactttaagtgggggggaggctcaaaggatcaaattagctaaagaattgagtaaaaaagacacaggcaaaaccctttatattttagatgagcctactaccggtttgcattttgaagacgtgaatcatcttttacaagtcttgcattctttagtggcgttaggcaattctatgctagtgattgagcataatttagacattatcaaaaacgctgactacattatagacatggggcctgatgggggggataagggcgggaaagtcattgcgagcggcacgcctttagaggtggcgcaaaattgcgaaaaaacccaaagctacacgggaaaatttttagctttggaattgaaa

SEQ ID NO: 98 - protein, 273 aa, Helicobacter pylori
NGVEIVGLEHLDKVIYLDQAPIGKTPRSNPATYTGVMDEIRILFAEQKEAKILGYSASRFSFNVKGGRCEKCQGDGDIKIEMHFLPDVLVQCDSCKGAKYNPQTLEIKVKGKSIADVLNMSVEEAYEFFAKFPKIAVKLKTLMDVGLGYITLGQNATTLSGGEAQRIKLAKELSKKDTGKTLYILDEPTTGLHFEDVNHLLQVLHSLVALGNSMLVIEHNLDIIKNADYIIDMGPDGGDKGGKVIASGTPLEVAQNCEKTQSYTGKFLALELK

SEQ ID NO: 99 - DNA, 1405 bp, Helicobacter pylori
  CDS (1)..(1404)
ggattcttacggattcttgatgttattaaaaaagttacgaccccaaagggtggcattgaaatcttaaggactttaattgattttacgcccaaaattgaaaacgccctgaatttagcggccaaaagccataaggggcaatacagaaaaagcggcgagccttatattgtccatcctatttgcgtggcaagcttggtagcgttttgtgggggcgatgaggcgatggtgtgtgctgcgcttttgcatgatgtggtggaagacacgccttgtaagattgaaacgattgagcaagaatttgggcaagatgtggctaatttagtggatgcgctcactaaaatcactgaaatcaggaaagaagaattaggcgtgagctctcaagatcccagaatggtggtttcagcgctcactttcagaaagattttaattagcgcgatacaagatccaagagccttagtggtaaagattagcgacaggttgcacaacatgctcaccttagacgccttgcctcatgacaagcaagtgcgtatttctaaagagactctagcggtgtatgcccctatagcgagccgattgggcatgtcttcaatcaaaaatgaattagaagacaagagcttttattatatttatccagaagagtataaaaatatcaaggaatatttgcacaaaaacaagcagtctttactcttaaagctcaacgcttttgcgagcaagttagaaaaaaaactttttgatagtgggtttagccattcggattttaaactcgttacaagggtgaaacgcccttattctatctatcttaagatgcaacgaaagggcgcggttaatattgatgaaattttggacttgttagccattaggattttattgaaaaacccgattgattgctataaagttttagggattatccatttgaatttcaaacccattgtctctcgttttaaagattacatcgctttgcccaaagaaaatggctataagacgatacacacgaccatttttgatgaatcttctgtttatgaagtgcagatccgcacctttgatatgcatatgggggcggagtatggtaattcagcccactggaagtataaagccgggggcgtggatcatgaagatcatcatgagggcatgagatggttgcaaaattttaaataccatgacagcgatttgaaaaacgaccctaaggaattttacgaactcgctaagaacgatttgtatcgtgaagatattgtcgttttttcgcctcatggggacacttacactttaccggtgggtgcgatcgctttagattttgcttacatggtgcatagcgatttgggcgataaagccacggacgcttatatcaatagtaaaaaagccttactcaatcaggaattaagaagtggggatgtggttaaaatcattaaaggcg

SEQ ID NO: 100 - protein, 468 aa, Helicobacter pylori
GFLRILDVIKKVTTPKGGIEILRTLIDFTPKIENALNLAAKSHKGQYRKSGEPYIVHPICVASLVAFCGGDEAMVCAALLHDVVEDTPCKIETIEQEFGQDVANLVDALTKITEIRKEELGVSSQDPRMVVSALTFRKILISAIQDPRALVVKISDRLHNMLTLDALPHDKQVRISKETLAVYAPIASRLGMSSIKNELEDKSFYYIYPEEYKNIKEYLHKNKQSLLLKLNAFASKLEKKLFDSGFSHSDFKLVTRVKRPYSIYLKMQRKGAVNIDEILDLLAIRILLKNPIDCYKVLGIIHLNFKPIVSRFKDYIALPKENGYKTIHTTIFDESSVYEVQIRTFDMHMGAEYGNSAHWKYKAGGVDHEDHHEGMRWLQNFKYHDSDLKNDPKEFYELAKNDLYREDIVVFSPHGDTYTLPVGAIALDFAYMVHSDLGDKATDAYINSKKALLNQELRSGDVVKIIKG

SEQ ID NO: 101 - DNA, 822 bp, Helicobacter pylori
  CDS (1)..(822)
cccaaagagagggttttaagcgatgaagaaatcaacaacagggctgaaaggatcgctaaaagcgagttagagaaggatacgaagctcgtttcatcacacgatcaatacgagcgcatgaaaaaaagcggatcgctcaacacggaaaacttagattcgcacattcaagccaacagcttacaagagctgaatcaaaaattgctccaattcgtgggcgcggataggaagtatatgccctacactaaagcggtgcaaatttctttgaataaccccaatcttaaagatttggaagtgattgacaccccaggagtgaatgaccccatcgcttccagggaagaacgcaccaaagccttattgaaagattgcgatgtggtgtttatcataagctcttctaatcagtttttaacggagagcgatatgagtttgtttgacagggtttctaacaaagaaagccttcaagaaatttattttgtggcaagccaagccgatagcgctgttctttctatgagtgaagtggaaaaatctcgccaccacctccccacagccttagaaaacgcgcaaaaatccctttcatcttctttaaataaaaccatggaagcattgattcaaacaaaccctaaccaacgagggatttttgaaaaagcgatcaaaaacggcgtcattttgacttcaggggcttgctttagcatgtataaggatttcaaaaaccaagcttcttgggaaagcaaaaaagaagagtgttacaatgcatggcggaatttaaccaacgcttaccccctgacgcttttaacagcgttgataaatctgaagaaagcttattattct

SEQ ID NO: 102 - protein, 274 aa, Helicobacter pylori
PKERVLSDEEINNRAERIAKSELEKDTKLVSSHDQYERMKKSGSLNTENLDSHIQANSLQELNQKLLQFVGADRKYMPYTKAVQISLNNPNLKDLEVIDTPGVNDPIASREERTKALLKDCDVVFIISSSNQFLTESDMSLFDRVSNKESLQEIYFVASQADSAVLSMSEVEKSRHHLPTALENAQKSLSSSLNKTMEALIQTNPNQRGIFEKAIKNGVILTSGACFSMYKDFKNQASWESKKEECYNAWRNLTNAYPLTLLTALINLKKAYYS

SEQ ID NO: 103 - DNA, 711 bp, Helicobacter pylori
  CDS (1)..(711)
agcgaaaaaaatatagaaaaggttttgaacgcctatgataagcaacaacaccaccatcaagacgatctcgctattcagtatttaccagccgtgcgcgccatggcgtttcgtctaaaagagcgcttgcccagctctattgattttaacgatctggtttctattggcactgaagaattgattaaattagccaggcgttatgagagcgcgttaaacgattctttttgggggtatgcgaagactcgtgtcaatggggcgatgttagattatttgcgctctttagatgtgatttctcgctctagcaggaaactcattaaaagcattgatattgaaatcaccaaacaccttaatgagcatgggaaagagcctagcgatgcgtatttagcgcaaactttaggcgaaaatattgaaaaaattaaagaagccaaaacggcttcagatatttatgcgttagtgccaatagatgaacaattcaatgcgattgagcaagatgaaatcactaaaaaaattgaagcagaagagttgttagagcatgtccaaaaagcgctgaatcaaatgagcgaaagagagcaaatccttatccagctttattactttgaagagttgaatttgagcgagattaaagagattttaggcattactgaatcgcgcatttctcaaatcattaaagaagtgattaaaaaggtgcgtaaatccttaggagtggatcatggc

SEQ ID NO: 104 - protein, 237 aa, Helicobacter pylori
SEKNIEKVLNAYDKQQHHHQDDLAIQYLPAVRAMAFRLKERLPSSIDFNDLVSIGTEELIKLARRYESALNDSFWGYAKTRVNGAMLDYLRSLDVISRSSRKLIKSIDIEITKHLNEHGKEPSDAYLAQTLGENIEKIKEAKTASDIYALVPIDEQFNAIEQDEITKKIEAEELLEHVQKALNQMSEREQILIQLYYFEELNLSEIKEILGITESRISQIIKEVIKKVRKSLGVDHG

SEQ ID NO: 105 - DNA, 1134 bp, Helicobacter pylori
  CDS (1)..(1134)
gaatacaaccgcctcaaacaacgcaccgagcatgatttagaaatgattagcgcgaccggtgtgtgtaagggcattgaaaattacgcgcgccatttcaccggtaaagcccctaacgaaacgcctttttgcttgtttgattatttagggatttttgagcgggagtttttagtcattgtggatgaaagccatgtgagtttgccacagtttggggggatgtatgcaggggatatgagcaggaaaagtgttttagtggaatatggttttagattgcctagcgctttagacaaccgccctttaaaatttgatgaatttatccataaaaattgccagttcctttttgtgtccgctacgcccaataagctagaattagagctttccaaaaagaatgtcgctgagcaaatcattcgccctacagggcttttagaccctaaatttgaagtgcgagacagcgataagcaagtccaggatttgtttgatgaaatcaagttagtggtggctagaggtgaaagggtgctcatcaccacgctcactaaaaaaatggcagaagaattgtgcaaatattatgctgaatggggcttgaaggcgcgttacatgcatagtgaaattgatgcgattgaaaggaatcacatcatccgctctttaaggcttaaagaatttgacattttaatagggatcaatcttttaagagaagggctggatttgcctgaagtctctttagtagcgatcatggatgcggataaagaagggtttttaaggagtgaaacaagcctcattcaaaccatggggcgagccgctagaaacgctaatggcaaggttttattatacgctaaaaagatcactcaaagcatgcaaaaagcctttgagatcactagttacaggcgcgccaaacaagaagagttcaataaaatccataacatcacccccaaaaccgttacgcgcgctttagaagaggaattgaaattaagagacgatgaaattagaatcgctaaagccttaaaaaaggacaaaatgcctaaaagtgaaagggaaaaaatcattaaagaattggataaaaaaatgcgagaatgcacgaagaatttggattttgaagaagcgatgcgtttgagagacgaaatcgctcaattaagaacgctt

SEQ ID NO: 106 - protein, 378 aa, Helicobacter pylori
EYNRLKQRTEHDLEMISATGVCKGIENYARHFTGKAPNETPFCLFDYLGIFEREFLVIVDESHVSLPQFGGMYAGDMSRKSVLVEYGFRLPSALDNRPLKFDEFIHKNCQFLFVSATPNKLELELSKKNVAEQIIRPTGLLDPKFEVRDSDKQVQDLFDEIKLVVARGERVLITTLTKKMAEELCKYYAEWGLKARYMHSEIDAIERNHIIRSLRLKEFDILIGINLLREGLDLPEVSLVAIMDADKEGFLRSETSLIQTMGRAARNANGKVLLYAKKITQSMQKAFEITSYRRAKQEEFNKIHNITPKTVTRALEEELKLRDDEIRIAKALKKDKMPKSEREKIIKELDKKMRECTKNLDFEEAMRLRDEIAQLRTL

SEQ ID NO: 107 - DNA, 499 bp, Helicobacter pylori
  CDS (1)..(498)
gaatccttacgagccttaaaagcttcgcaagaagtgcaggctaacacgcttaagcagcaatcgcaaactttagaggatttgaggaatgagattcacgctaaccagcaagctatccagcagttagacaagcaaaataaagagatgagtgaattattgaccaagttaagccaggatttggtttcacaaatcgccttaatccaaaaagctctcaaagaacaagaggaaaaagctgaaaagccgctcaaatcaaacgctccggctaataaaaccccctctttgaaagccgaatccccaaaaaatcaagagggaaaaactcaagaaaaggcgaaaattgagtttgataaagacttgtctaagcaaaaagagatctttcaagaagctctgtctttttttaaaaataaatcctatgcagaagccaaagagcgtttgttgtggttagaagccaatagttacagactttattatgtgcgttatgttcttggagaagtggcttatgggg

SEQ ID NO: 108 - protein, 166 aa, Helicobacter pylori
ESLRALKASQEVQANTLKQQSQTLEDLRNEIHANQQAIQQLDKQNKEMSELLTKLSQDLVSQIALIQKALKEQEEKAEKPLKSNAPANKTPSLKAESPKNQEGKTQEKAKIEFDKDLSKQKEIFQEALSFFKNKSYAEAKERLLWLEANSYRLYYVRYVLGEVAYG

SEQ ID NO: 109 - DNA, 133 bp, Helicobacter pylori
  CDS (1)..(132)
cacactctaaaagaaatgctcaccattaaatccgatgatattagaggcagagagaacgcttatagggctatcgctaaaggtgagcaagtgggcgagagtgaaatccctgagactttctatgttttgactaaag

SEQ ID NO: 110 - protein, 44 aa, Helicobacter pylori
HTLKEMLTIKSDDIRGRENAYRAIAKGEQVGESEIPETFYVLTK

SEQ ID NO: 111 - DNA, 932 bp, Helicobacter pylori
  CDS (1)..(930)
ttagcccaaatgcgtttagccattgaagcggctgaaggctctgatttgagcaacgctaacatgctttttaaagaagctttttctaacgccaaagacaaagagagtgcgagtgaaatcgcgcttaattgggctgaagcagagataaactatcaaaattttaataacgctaaatacctcattgataaggtggtccaatccaaccctgattatatttctacgcatagcgaatcagccctagacttgctcaagttattgaaaaaaaaccagatgaatgcaagcgcgattgagatcgctcacttgctcctcaatcaagatgatgatctgaaagctaaagagcaagcgctttatgatttaggagcgttgtatgcaaggatcaaggactttaaaaacgcccacctttacaatctgcaatatttgcaggaccatgcggaactggataaagcttctgtcgttagggcgcgcgatgaaaaagcccttttttccatggaggggaacacgcaagaaaaaatcgcccactatgacaaaatcattcaaaatttccctaattctaatgaagccctaaaggctttagaattgaaagcccaactattgtttgaaaacaagcgttatgctgaagtgttaagcatgcaaaaaaatttgcctaaagattcccctttgatccaaaaaacgctcaatgtccttgctaaaaccccattagagaaccatcgttgtgaagaagccttaaaatatttatcccaaatcacaacctttgaattcagccccaaagaagaaatccaagcctttgattgcttgtatttcgcatcgctcaaagaaaaagcgcaaatcattgccctaaacgcttttaaaacggctaaagcccctagcgagaaattaatatggctttatcgtttggggcgcaattactaccgcttaggggattttaaaaattccac

SEQ ID NO: 112 - protein, 310 aa, Helicobacter pylori
LAQMRLAIEAAEGSDLSNANMLFKEAFSNAKDKESASEIALNWAEAEINYQNFNNAKYLIDKVVQSNPDYISTHSESALDLLKLLKKNQMNASAIEIAHLLLNQDDDLKAKEQALYDLGALYARIKDFKNAHLYNLQYLQDHAELDKASVVRARDEKALFSMEGNTQEKIAHYDKIIQNFPNSNEALKALELKAQLLFENKRYAEVLSMQKNLPKDSPLIQKTLNVLAKTPLENHRCEEALKYLSQITTFEFSPKEEIQAFDCLYFASLKEKAQIIALNAFKTAKAPSEKLIWLYRLGRNYYRLGDFKNS

SEQ ID NO: 113 - DNA, 591 bp, Helicobacter pylori
  CDS (1)..(591)
gcgaacaaaaagaaaaaaaaagacgaatacaacaaaccggcgatcttttggtatcaagggattttgagagaaatcctttttgctaatttagaaacagcggacaattactattcttctttacaaagcgaacacatcaattccccccttgtcccagaagcgatgctagctttagggcaagcgcacatgaaaaagaaagagtatgttttagcgtctttttactttgatgaatacatcaagcgctttgggactaaggacaatgtggattatttgacttttttaaaattgcaatcgcattattacgctttcaaaaaccattctaaagaccaggaatttatctctaattctattgtgagtttaggcgaatttatagaaaaataccctaacagccgttaccgcccctatgtagaatacatgcaaatcaaattcattttagggcaaaatgagctcaatcgcgcgatcgcgaatgtctataaaaaacgccacaagcctgagggcgtgaaacgctatttagaaaggatagatgagactttagaaaaagagactaaacccaaaccatcgcacatgccttggtatgtgttaatttttgattgg

SEQ ID NO: 114 - protein, 197 aa, Helicobacter pylori
ANKKKKKDEYNKPAIFWYQGILREILFANLETADNYYSSLQSEHINSPLVPEAMLALGQAHMKKKEYVLASFYFDEYIKRFGTKDNVDYLTFLKLQSHYYAFKNHSKDQEFISNSIVSLGEFIEKYPNSRYRPYVEYMQIKFILGQNELNRAIANVYKKRHKPEGVKRYLERIDETLEKETKPKPSHMPWYVLIFDW

SEQ ID NO: 115 - DNA, 498 bp, Helicobacter pylori
  CDS (1)..(498)
tttaaaccctttaaagacgctttttacagagatttcaatcataatgagcaaaagttactgataggggcagctaaaagcggttgcattcaatctagcgctgataaactggctcagttaaaaacgcgcttactctactggcaagacaaatctgttaaagtggattgggataaacccattttaatcaaggacttctttaaaggcaataattacctttataggaggttttgttttttattggggaagcattttatggacagatttttaaagaataacgctaaggcgagcgtgaaagactttatgtctagtaaggagtttgtcgctaaataccgatacacccccaagcaaaatacagaaagagcgaaaaagctgcaatcgtatttagagaataagcgcgattttatagggtttgttcaagcgcttaactctttaaaagacaacccgcaagatccttttttacccaatgaagaaacgagctttttggtgttcgctaatgagcct

SEQ ID NO: 116 - protein, 166 aa, Helicobacter pylori
FKPFKDAFYRDFNHNEQKLLIGAAKSGCIQSSADKLAQLKTRLLYWQDKSVKVDWDKPILIKDFFKGNNYLYRRFCFLLGKHFMDRFLKNNAKASVKDFMSSKEFVAKYRYTPKQNTERAKKLQSYLENKRDFIGFVQALNSLKDNPQDPFLPNEETSFLVFANEP

SEQ ID NO: 117 - DNA, 399 bp, Helicobacter pylori
  CDS (1)..(399)
ctcgctttgaatgagttgaatccgggcgaatgggtggtgcatgatgattatggggtgggcgtgttttctcaattagtccagcacagcgttttagggagcaagagggattttttagaaatcgcttatttgggcgaagacaaactgctgttaccggtagaaaacttgcatctcatcgctcgctatgtggcgcaaagcgatagcgtgccagctaaagaccggctagggaaagggagctttcttaaattaaaagctaaagtcaggactaagcttttagagattgctagcaagatcattgaattagcggctgaacgcaatttgatcttgggtaaaaagatggatgtgcatttagcggagttggaagtctttaaatcgcatgcggggtttgaatacaccagcgat

SEQ ID NO: 118 - protein, 133 aa, Helicobacter pylori
LALNELNPGEWVVHDDYGVGVFSQLVQHSVLGSKRDFLEIAYLGEDKLLLPVENLHLIARYVAQSDSVPAKDRLGKGSFLKLKAKVRTKLLEIASKIIELAAERNLILGKKMDVHLAELEVFKSHAGFEYTSD

SEQ ID NO: 119 - DNA, 426 bp, Helicobacter pylori
  CDS (1)..(426)
gttttaaacgcacccatcactttagaagacattcaagaattaagctccaatgcgggggatatggatttgcaaaagctcattttagggctttttttaaaaaaaagtgcgcttgatatttatgattatttgttaaaagagggcaaaaaagatgcggatattttaagggggttagagcgctatttttaccaactttttttatttttcgctcatattaaaacgaccggtttaatggacgctaaagaggttttaggctacgctccccctaaagaaattgccgaaaattacgctaaaaacgccttgcgtttgaaagaagccggctataagagggtttttgaaatttttaggttatggcacattcaaagcatgcaagggcaaaaggaattgggctttttgtatttgacctccattcaaaaaatcattaacccc

SEQ ID NO: 120 - protein, 142 aa, Helicobacter pylori
VLNAPITLEDIQELSSNAGDMDLQKLILGLFLKKSALDIYDYLLKEGKKDADILRGLERYFYQLFLFFAHIKTTGLMDAKEVLGYAPPKEIAENYAKNALRLKEAGYKRVFEIFRLWHIQSMQGQKELGFLYLTSIQKIINP

SEQ ID NO: 121 - DNA, 297 bp, Helicobacter pylori
  CDS (1)..(297)
gaagaatgcggcacgcttttagaattgagggaaaaaatttcgttgtttttagagccaaaggatattgttaaaacttatgaaaatgaagattttaaagagcgttgtttagcgctttttaacgctctaacaagcatggattttcaagcgtataaggattttgaaagttttaaaaaagaagccatgcgattaagccagcttaagggtaaggattttttcaaacctttgcgcatccttttaaccgggaactcgcatggcgttgaattgcctttgattttcccctatatccaaagccatcat

SEQ ID NO: 122 - protein, 99 aa, Helicobacter pylori
EECGTLLELREKISLFLEPKDIVKTYENEDFKERCLALFNALTSMDFQAYKDFESFKKEAMRLSQLKGKDFFKPLRILLTGNSHGVELPLIFPYIQSHH

SEQ ID NO: 123 - DNA, 42 bp, Helicobacter pylori
  CDS (1)..(42)
ccccaaatcgtagctaaagattttttagaaagattagggtta

SEQ ID NO: 124 - protein, 14 aa, Helicobacter pylori
PQIVAKDFLERLGL

SEQ ID NO: 125 - DNA, 84 bp, Helicobacter pylori
  CDS (1)..(84)
aagaaagcgattgaaaataaccagtataaaatcaacttgcatgagacttctcacaaaatggcaaaggatttattggggataagc

SEQ ID NO: 126 - protein, 28 aa, Helicobacter pylori
KKAIENNQYKINLHETSHKMAKDLLGIS

SEQ ID NO: 127 - DNA, 356 bp, Helicobacter pylori
  CDS (1)..(354)
cacatttatgaaaaagaagtggatgctagggagcttaagcatggtgtggaagaatttaccgctgatattcctgatgtgaaagaagaagcgctcgctcatcttgatgaaagcgggatcgttaaagtcggtacttatgtgagcgctggcatgattttggtgggcaaaacttctcctaaaggcgagattaaaagcacgcctgaagagcggcttttaagggctatttttggggataaagccgggcatgtggtcaataagagtttgtattgccctcccagtttggaaggcacggtgattgatgtgaaagtcttcactaaaaaaggctatgagaaagacgcgcgagttttgagcgcgtatga

SEQ ID NO: 128 - protein, 118 aa, Helicobacter pylori
HIYEKEVDARELKHGVEEFTADIPDVKEEALAHLDESGIVKVGTYVSAGMILVGKTSPKGEIKSTPEERLLRAIFGDKAGHVVNKSLYCPPSLEGTVIDVKVFTKKGYEKDARVLSAY

SEQ ID NO: 129 - DNA, 698 bp, Helicobacter pylori
  CDS (1)..(696)
tataagccctacaccccaagcagacgcttcatgtcggtgttggactctaaagacattaccgcaaaaagcagtgtcaaaggcttactcactaagcttaaagcaacagcagggagaaacaataacgggcgcatcaccagccgccacaaagagagaggggctaaaaaactctatcgcattattgatttcaagcgcaataaatacaatattgaagggaaagtggctgcgattgagtatgatccttacagaaatgcgcgcatcgctcttgtagtctatcctgatggggacaaacgctatattttacagccaagcggtttgaaagtgggcgatagcgttatcgctgctgaaggcggtttggatattaaagtgggctttgcgatgaagttaaaaaatatccccataggaacggtggtgcataatattgaaatgcatccaggggctggcgggcaattagccagaagcgcaggaatgagcgctcaaatcatgggtagagaaaataaatacaccattattaggatgccaagctctgaaatgcgctacattctaagcgaatgtatggcgagtgttggcgtggtagggaatgaggattttatcaatgtctctatcggtaaggcagggcgtaaccgccacagagggatccgcccacaaactcgtggtagcgcgatgaacccagtggatcacccgcatggtgggggtgaggg

SEQ ID NO: 130 - protein, 232 aa, Helicobacter pylori
YKPYTPSRRFMSVLDSKDITAKSSVKGLLTKLKATAGRNNNGRITSRHKERGAKKLYRIIDFKRNKYNIEGKVAAIEYDPYRNARIALVVYPDGDKRYILQPSGLKVGDSVIAAEGGLDIKVGFAMKLKNIPIGTVVHNIEMHPGAGGQLARSAGMSAQIMGRENKYTIIRMPSSEMRYILSECMASVGVVGNEDFINVSIGKAGRNRHRGIRPQTRGSAMNPVDHPHGGGE

SEQ ID NO: 131 - DNA, 528 bp, Helicobacter pylori
  CDS (1)..(528)
tacgattggatcaaggaatttgtgcgcgatcaaggagagtttatcgcccaacaaagcgggtggctggaattagagcgatcaagctatgccaaactcatcgcgcaaaccatctcgcatgtgcttaatggcggatcgctgttggtgagcgcggattcttctaggcactggtttttaaactacattctttctaacctaaaccccaaagatttaaaagagcgccccttattgtccgtcattgattttaacgcttcttctttctaccccaaaaacgatgcgaatctctctctagccaccatagagatgacttatcaaaaccccatgttttggcatgttgggaaaattgaaaatgaaggcttaaaaacgatactattgagtaaaatccctagttttttatggctttttgaagagcttaaagaagattgcttgcttttaaaagagcatgacagcttgctggattataaattattgcagctcttcaaactctttgaaaacgcgctttttagcgtgctatacaataaggttactctg

SEQ ID NO: 132 - protein, 176 aa, Helicobacter pylori
YDWIKEFVRDQGEFIAQQSGWLELERSSYAKLIAQTISHVLNGGSLLVSADSSRHWFLNYILSNLNPKDLKERPLLSVIDFNASSFYPKNDANLSLATIEMTYQNPMFWHVGKIENEGLKTILLSKIPSFLWLFEELKEDCLLLKEHDSLLDYKLLQLFKLFENALFSVLYNKVTL

SEQ ID NO: 133 - DNA, 263 bp, Helicobacter pylori
  CDS (1)..(261)
ttggcgctagtcaaacaaaatcctaaagttagtctcatagagtatgaaaattactttagccaactcaaatacaaccctaacgcaagcaagagcgatattgcctttttttatgcccccaaccaagtcttatgcaccacgattacagctaaatacggcgcgttgcttaaagaaattttaagccagaataaagtcggcatgcatttagcccacagcgtggatgtgcgtattgaagtagcgcctaaaatccaaattaacgcccaatc

SEQ ID NO: 134 - protein, 87 aa, Helicobacter pylori
LALVKQNPKVSLIEYENYFSQLKYNPNASKSDIAFFYAPNQVLCTTITAKYGALLKEILSQNKVGMHLAHSVDVRIEVAPKIQINAQ

SEQ ID NO: 135 - DNA, 447 bp, Helicobacter pylori
  CDS (1)..(447)
agctatgccaaactcatcgcgcaaaccatctcgcatgtgcttaatggcggatcgctgttggtgagcgcggattcttctaggcactggtttttaaactacattctttctaacctaaaccccaaagatttaaaagagcgccccttattgtccgtcattgattttaacgcttcttctttctaccccaaaaacgatgcgaatctctctctagccaccatagagatgacttatcaaaaccccatgttttggcatgttgggaaaattgaaaatgaaggcttaaaaacgatactattgagtaaaatccctagttttttatggctttttgaagagcttaaagaagattgcttgcttttaaaagagcatgacagcttgctggattataaattattgcagctcttcaaactctttgaaaacgcgctttttagcgtgctatacaataaggttactctg

SEQ ID NO: 136 - protein, 149 aa, Helicobacter pylori
SYAKLIAQTISHVLNGGSLLVSADSSRHWFLNYILSNLNPKDLKERPLLSVIDFNASSFYPKNDANLSLATIEMTYQNPMFWHVGKIENEGLKTILLSKIPSFLWLFEELKEDCLLLKEHDSLLDYKLLQLFKLFENALFSVLYNKVTL

SEQ ID NO: 137 - DNA, 795 bp, Helicobacter pylori
  CDS (1)..(795)
ggacttggaggagggactgggactggagccacccctactatcgttaaaatcgcaaaagaagtgggagcgctcacgattgctatcgttaccaagcctttcaaatacgaagggaatcaaaaaagaaagagggctgaagagggattgaaagaattggagcagtctagcgattctattttggttatccctaatgacaaaatccttctcaccatgaaaaaaaacgctagcaccacggagtgttatagggaagttgatgatgtcttggttagggctgtgagtggcatttctactatcatcactaaacccggtaatatcaatgttgattttgccgatttaaagagcgctcttggttttaaaggctttgcgttaatgggtattggtgaagccactggcgaagaatccgctaaattagcggtgcaaaatgcgatccaatcgcctcttcttgatgacgcttctattgaaggggctaagagcattattgtcttttttgagcaccaccctgattatcctatgatggcttattctcaagcgtgcgattttattcaagatcaagcccatcaagatgttgacgttaagtttggccaacacacgagcgataatatccctattgatcatgtgcgcgttactatcattgcaaccggtgctgaaagaaacagcggtggagcgagtttggaatctatcgctacgccctctcagcctgtggtgaaacaaacgagaaaagtgggtaatggcgagtatttaaagatccctactgaagaagagctatccatacccacaaccatgagaatccagcaagac

SEQ ID NO: 138 - protein, 265 aa, Helicobacter pylori
GLGGGTGTGATPTIVKIAKEVGALTIAIVTKPFKYEGNQKRKRAEEGLKELEQSSDSILVIPNDKILLTMKKNASTTECYREVDDVLVRAVSGISTIITKPGNINVDFADLKSALGFKGFALMGIGEATGEESAKLAVQNAIQSPLLDDASIEGAKSIIVFFEHHPDYPMMAYSQACDFIQDQAHQDVDVKFGQHTSDNIPIDHVRVTIIATGAERNSGGASLESIATPSQPVVKQTRKVGNGEYLKIPTEEELSIPTTMRIQQD

SEQ ID NO: 139 - DNA, 342 bp, Helicobacter pylori
  CDS (1)..(342)
gcggtttctcaactcattcaagtgggagcgttagtcaagtttttgttagcgtttcaaaaaagcactcaagctaaaatcgttcaagtgtgtggttttaacccccatgcgggcgaagagggcttatttggggaagaagatgaaaggattttaaaagccattcaaaagagcaaccaaacgctaggctttgaatgctttttggggccactgccggctgatagtgcttttgcccccaataaacgaaaaataacccctttttatgtgagcatgagccatgatgtggggctagcccctttaaaagcgctctattttgatgaaagcattaatgtgagtttgaacgccccc

SEQ ID NO: 140 - protein, 114 aa, Helicobacter pylori
AVSQLIQVGALVKFLLAFQKSTQAKIVQVCGFNPHAGEEGLFGEEDERILKAIQKSNQTLGFECFLGPLPADSAFAPNKRKITPFYVSMSHDVGLAPLKALYFDESINVSLNAP

SEQ ID NO: 141 - DNA, 869 bp, Helicobacter pylori
  CDS (1)..(867)
ggcgggattgcgtgcgcgaatttgttgcataaaaattcagggatcacgatagatattggagggggtagcaccgagtgcgcgttgattgaaaaaggcaagattaaggacttaatctcgcttgatgttgggacgattcgcattaaagaaatgtttttagacaaagacttagaggtcaaattggctaaagcctttatccaaaaagaagtctctaaactgccctttaaacacaaaaacgcctttggggtgggggggacgatcagagcgttgagtaaggtattgatgaaacgcttttgttaccctattgattctttgcatggctatgaaatagatgcacataaaaatttagcgttcattgaaaaaatcgtcatgctcaaagaagatcaattacggcttttaggggtgaatgaagagcgtttggatagcatcaggagcggggcgttgattttatcagtcgttttggagcatttaaaaacttctttaatgatcactagtggggtgggggtgagagaaggcgtgtttttgagcgatttattgcgccatcattaccataaattcccccccaatatcaacccctctctcatctctttaaaagatcgctttttgccccatgaaaagcacagccaaaaggtcaaaaaagaatgcgtgaaattgtttgaagccttatcgcctttgcataaaatagatgaaaaataccttttccatttaaagattgcgggggaattagcgagcatgggtaagattttaagcgtctatttagcccacaagcacagcgcgtattttattttaaacgctttgagttatggctttagccaccaggatagagcgatcatttgcttattagcccaattcagccataaaaaaatccctaa

SEQ ID NO: 142 - protein, 289 aa, Helicobacter pylori
GGIACANLLHKNSGITIDIGGGSTECALIEKGKIKDLISLDVGTIRIKEMFLDKDLEVKLAKAFIQKEVSKLPFKHKNAFGVGGTIRALSKVLMKRFCYPIDSLHGYEIDAHKNLAFIEKIVMLKEDQLRLLGVNEERLDSIRSGALILSVVLEHLKTSLMITSGVGVREGVFLSDLLRHHYHKFPPNINPSLISLKDRFLPHEKHSQKVKKECVKLFEALSPLHKIDEKYLFHLKIAGELASMGKILSVYLAHKHSAYFILNALSYGFSHQDRAIICLLAQFSHKKIP

SEQ ID NO: 143 - DNA, 609 bp, Helicobacter pylori
  CDS (1)..(609)
agtttgatcgcaaacgcgcttttgcaatcaagctttttgctctatgcgttcatgccaaagagcgctgtgaaattagcgaatgctttcaacacagaaatcacgcccgataattacgaacgcttttttaaagctaaaaaattacaagatatgattttacaagacaccgagcctttattttccaaaatggagaaaattgaaaagacggaaaaagcgggagaagcctcaccagaaaaaaacgaaaaagaaaaaaaggacgcaaaagaaaaagccccactaaaacaagaaaactatatcggcattgaggatttcaaaaaagtagagatcaaagtggggcttatcaaagaagctcaaaggattgaaaaatccaataaattactgcgcttaaaagtggatttaggcgaaggccgtttgaggcagattatttcagggatcgctttggattatgagcctgaaagcttggtgggtcaaatggtgtgcgtggtggctaatttaaaacccgcaaagcttatgggcgaaatgagtgagggcatgattttagcggtgcgagatagcgacaatctagccttaattagccccactagagaaaaaattgcaggaagtttgatcagc

SEQ ID NO: 144 - protein, 203 aa, Helicobacter pylori
SLIANALLQSSFLLYAFMPKSAVKLANAFNTEITPDNYERFFKAKKLQDMILQDTEPLFSKMEKIEKTEKAGEASPEKNEKEKKDAKEKAPLKQENYIGIEDFKKVEIKVGLIKEAQRIEKSNKLLRLKVDLGEGRLRQIISGIALDYEPESLVGQMVCVVANLKPAKLMGEMSEGMILAVRDSDNLALISPTREKIAGSLIS

SEQ ID NO: 145 - DNA, 1458 bp, Helicobacter pylori
  CDS (1)..(1458)
tttgaaaacgcaaaagctgaatgcagtttagtttttattatcaataaggattttagccacgcttgggtcaaaaataaagagttgctagaaacctttaaatacgaaggcgaaggcgtatttttagaccaagaaaataaaatcctgtatgcgggcgttaaagaagatgatgtgcatttattgagagagagcgcgtgtttagccgttcgcacccttaaaaaactcgcttttaaaagcgttaaagtgggcgtttatacttgtggtgcacattctaaagataacgcgcttttagaaaacttgaaagcgctgtttttgggcttgaaattaggtttgtatgaatacgacacttttaaatccaacaaaaaagaaagcgttttaaaagaagccattgtcgctttagaattgcacaaaccttgcgaaaaaacttgcgcaaattctttagaaaagagtgctaaagaagcgttaaaatacgctgaaatcatgacagaaagcttgaatatcgttaaagatctagtcaataccccccctatgattggcactccggtttatatggctgaagtggcgcaaaaagtggctaaagaaaaccatttagaaatccatgttcatgatgaaaaatttttagaagaaaagaaaatgaacgcctttttagcggtcaataaagcctctcttagcgtcaatcctcctcgcttgatccatttagtctataagcctaaaaaagcgaagaaaaaaatcgctttagtgggtaagggcttgacttatgattgtgggggtttgagcttgaaaccggccgattacatggttactatgaaagcggataaaggcggtggctctgcggtgattgggcttttaaacgcattagccaaactaggcgtggaggctgaagtgcatggcattattggggctacagaaaacatgataggcccagccgcttataaaccagatgatattttgatctccaaagaaggcaagagcatagaggtccgtaataccgacgctgaggggcgtttggttttagcggattgtttgagctacgctcaagatttaaaccctgatgtgatcgtggattttgcgacccttactggggcatgcgttgtaggcttaggcgaattcacttcagcgatcatggggcataatgaagagttaaaaaacctctttgaaacttcagggttagaatccggcgaattattagccaaactcccctttaaccgccatttaaagaaattgattgaatctaaaatcgctgatgtgtgcaatatttcttcttcacgctatggcggtgcgatcacagcgggcttgtttttaaatgaatttattagagatgagtttaaggataagtggctacacattgacattgcaggccctgcttatgtggaaaaagaatgggatgtgaatagctttggagcgagtggggctggcgtgagagcttgcacagcttttgtggaagagcttttgaaaaaggct

SEQ ID NO: 146 - protein, 486 aa, Helicobacter pylori
FENAKAECSLVFIINKDFSHAWVKNKELLETFKYEGEGVFLDQENKILYAGVKEDDVHLLRESACLAVRTLKKLAFKSVKVGVYTCGAHSKDNALLENLKALFLGLKLGLYEYDTFKSNKKESVLKEAIVALELHKPCEKTCANSLEKSAKEALKYAEIMTESLNIVKDLVNTPPMIGTPVYMAEVAQKVAKENHLEIHVHDEKFLEEKKMNAFLAVNKASLSVNPPRLIHLVYKPKKAKKKIALVGKGLTYDCGGLSLKPADYMVTMKADKGGGSAVIGLLNALAKLGVEAEVHGIIGATENMIGPAAYKPDDILISKEGKSIEVRNTDAEGRLVLADCLSYAQDLNPDVIVDFATLTGACVVGLGEFTSAIMGHNEELKNLFETSGLESGELLAKLPFNRHLKKLIESKIADVCNISSSRYGGAITAGLFLNEFIRDEFKDKWLHIDIAGPAYVEKEWDVNSFGASGAGVRACTAFVEELLKKA

SEQ ID NO: 147 - DNA, 960 bp, Helicobacter pylori
  CDS (1)..(960)
gatgttattaaaaaagttacgaccccaaagggtggcattgaaatcttaaggactttaattgattttacgcccaaaattgaaaacgccctgaatttagcggccaaaagccataaggggcaatacagaaaaagcggcgagccttatattgtccatcctatttgcgtggcaagcttggtagcgttttgtgggggcgatgaggcgatggtgtgtgctgcgcttttgcatgatgtggtggaagacacgccttgtaagattgaaacgattgagcaagaatttgggcaagatgtggctaatttagtggatgcgctcactaaaatcactgaaatcaggaaagaagaattaggcgtgagctctcaagatcccagaatggtggtttcagcgctcactttcagaaagattttaattagcgcgatacaagatccaagagccttagtggtaaagattagcgacaggttgcacaacatgctcaccttagacgccttgcctcatgacaagcaagtgcgtatttctaaagagactctagcggtgtatgcccctatagcgagccgattgggcatgtcttcaatcaaaaatgaattagaagacaagagcttttattatatttatccagaagagtataaaaatatcaaggaatatttgcacaaaaacaagcagtctttactcttaaagctcaacgcttttgcgagcaagttagaaaaaaaactttttgatagtgggtttagccattcggattttaaactcgttacaagggtgaaacgcccttattctatctatcttaagatgcaacgaaagggcgcggttaatattgatgaaattttggacttgttagccattaggattttattgaaaaacccgattgattgctataaagttttagggattatccatttgaatttcaaacccattgtctctcgttttaaagattacatcgctttgcccaaagaaaatggctataagacg

SEQ ID NO: 148 - protein, 320 aa, Helicobacter pylori
DVIKKVTTPKGGIEILRTLIDFTPKIENALNLAAKSHKGQYRKSGEPYIVHPICVASLVAFCGGDEAMVCAALLHDVVEDTPCKIETIEQEFGQDVANLVDALTKITEIRKEELGVSSQDPRMVVSALTFRKILISAIQDPRALVVKISDRLHNMLTLDALPHDKQVRISKETLAVYAPIASRLGMSSIKNELEDKSFYYIYPEEYKNIKEYLHKNKQSLLLKLNAFASKLEKKLFDSGFSHSDFKLVTRVKRPYSIYLKMQRKGAVNIDEILDLLAIRILLKNPIDCYKVLGIIHLNFKPIVSRFKDYIALPKENGYKT

SEQ ID NO: 149 - DNA, 324 bp, Helicobacter pylori
  CDS (1)..(324)
ttgctagcgattgtgttgagcatttctacttttattgcacaaggtaagattaaggtcagtctccctaacgctaaaaatgcggaaaaatcccagccaaacgatcaaaaagtggtggtcatctctgtagatgagcatgacaatattttcgtagatgacaaaccgatgaatttagaagctttgagcgctgtagtcaaacaaacagaccctaaaacccttatagacttaaaaagcgacaaaagctctcgttttgaaacttttatcagcattatggatattttaaaagagcataatcatgaaaatttctccatctccacgcaagctcag

SEQ ID NO: 150 - protein, 108 aa, Helicobacter pylori
LLAIVLSISTFIAQGKIKVSLPNAKNAEKSQPNDQKVVVISVDEHDNIFVDDKPMNLEALSAVVKQTDPKTLIDLKSDKSSRFETFISIMDILKEHNHENFSISTQAQ

SEQ ID NO: 151 - DNA, 837 bp, Helicobacter pylori
  CDS (1)..(837)
gacagcaaaaaagacgcttgcgggttcatctatgagatcagcgagttcatgaaagcctataccgcattgctaaaaaaacaagaccgatacgtctatttattgaggtatctcccctctaggtattgggccagcattttaacgactgccctttatgtcaaataccctgattttgacgctttgaaaaagcttttggtgtcttattattaccaaacttggattgcaggaggcacgatcacgcgcatcaagcaaaccagtatcaacattatcaaaaacgttaaaagcaataagagcgttgaaaccatcaaagagcttatattgaatagcatcgactcttataacacctttgatcaatacctctataacttatgggatagctcttctgtttatcatagcaaatgggtgcgtcctgtcttagccctagctaattatttcatggcagatgaagagaaaccccattttatcgctatggatgccgaaacccaagtggagcatattttgccacaaacgcccaaaagaggcagtcaatggaacgcggattttgacaaagaaaaaagagaagaatgggtaaataatatcgcgaatttaacccttttaaagcgtaaaaagaacgcgcatgctttaaacggggattttgatgaaaaaagaaaaatttatggaggcaaagacacgagcaaagtgattagctgttatgacatcactaaagaattgtatagcaattataggaagtggaatgagaagtccctccaagagcgatacaaatctttgtataacactatcacgcctgttttacacatagaggggcaagaagatgattttgaagatgattttgatctagaa

SEQ ID NO: 152 - protein, 279 aa, Helicobacter pylori
DSKKDACGFIYEISEFMKAYTALLKKQDRYVYLLRYLPSRYWASILTTALYVKYPDFDALKKLLVSYYYQTWIAGGTITRIKQTSINIIKNVKSNKSVETIKELILNSIDSYNTFDQYLYNLWDSSSVYHSKWVRPVLALANYFMADEEKPHFIAMDAETQVEHILPQTPKRGSQWNADFDKEKREEWVNNIANLTLLKRKKNAHALNGDFDEKRKIYGGKDTSKVISCYDITKELYSNYRKWNEKSLQERYKSLYNTITPVLHIEGQEDDFEDDFDLE

SEQ ID NO: 153 - DNA, 684 bp, Helicobacter pylori
  CDS (1)..(684)
ttgatgctccactatgctggagaattggctaaaaaacgcaaagaaaaaggcattaagcttaactatgtagaagcggtagctttgattagtgcccatattatggaagaagcgagagctggtaaaaagactgcggctgaattgatgcaagaagggcgcactcttttaaaaccggatgatgtgatggatggcgtggcaagcatgatccatgaagtgggtattgaagcgatgtttcctgatgggacaaaactcgtaaccgtgcatacccctattgaggccaatggtaaattagttcctggtgagttgttcttaaaaaatgaagacatcactatcaacgaaggcaaaaaagccgttagcgtgaaagttaaaaatgttggcgacagaccggttcaaatcggctcacacttccatttctttgaagtgaatagatgcttagactttgacagagaaaaaactttcggtaaacgcttagacattgcgagcgggacagcggtaaggtttgagcctggcgaagaaaaatccgtagaattgattgacattggcggtaacagaagaatctttggatttaacgcgttggttgataggcaagcagacaacgaaagcaaaaaaattgctttacacagagctaaagagcgtggttttcatggcgctaaaagcgatgacaactatgtaaaaacaattaaggag

SEQ ID NO: 154 - protein, 228 aa, Helicobacter pylori
LMLHYAGELAKKRKEKGIKLNYVEAVALISAHIMEEARAGKKTAAELMQEGRTLLKPDDVMDGVASMIHEVGIEAMFPDGTKLVTVHTPIEANGKLVPGELFLKNEDITINEGKKAVSVKVKNVGDRPVQIGSHFHFFEVNRCLDFDREKTFGKRLDIASGTAVRFEPGEEKSVELIDIGGNRRIFGFNALVDRQADNESKKIALHRAKERGFHGAKSDDNYVKTIKE

SEQ ID NO: 155 - DNA, 486 bp, Helicobacter pylori
  CDS (1)..(486)
ttagaagagcaaaaggataaatcttacaaggttgttgaagaataccccagctcaagaacccacattatagtgcgcgatttgcaaggcaatgaacgcgtgttaagcaatgaagagattcaaaagctcatcaaagaagaagaagctaaaattgataacggcacgagcaagcttgtccagcctaataatggagggagtaatgaaggctcaggctttggcttggggagcgcgattttagggagcgcggcgggggcgattttagggagttatattggtaataagcttttcaataaccctaattaccagcaaaacgcccaacggacctacaaatccccacaagcttaccaacgctctcaaaattccttttctaaaagtgcgcccagtgcttcaagcatgggcggagcgagtaagggacagagcgggttttttggctctagtaggcctactagttcaccggcggtaagctctgggacaaggggctttaactca

SEQ ID NO: 156 - protein, 162 aa, Helicobacter pylori
LEEQKDKSYKVVEEYPSSRTHIIVRDLQGNERVLSNEEIQKLIKEEEAKIDNGTSKLVQPNNGGSNEGSGFGLGSAILGSAAGAILGSYIGNKLFNNPNYQQNAQRTYKSPQAYQRSQNSFSKSAPSASSMGGASKGQSGFFGSSRPTSSPAVSSGTRGFNS

SEQ ID NO: 157 - DNA, 1032 bp, Helicobacter pylori
  CDS (1)..(1032)
acttttttgcaagttagggttcaaggggaagtgagtaatttgactatccataaggtgagcggccatgcgtatttttcgctcaaagacagccagtcggttattaaatgcgtgctgtttaaagggaacgctaacaggctcaaattcgctttaaaagaagggcaggaagtggttgtttttgggggtattagcgtgtatgtcccaaggggggattatcaaatcaattgctttgaaatagagcctaaggatataggttcattaactttagctttagagcaattgaaagaaaaattacgccttaaaggctattttgatgaagaaaataaattacccaaaccgcattttcctaaacgagtggcagtcatcacttctcaaaattcagccgcttgggcggacatgaaaaagatcgcttccaaacgatggccgatgtgtgaattagtttgtatcaacaccttaatgcaaggggagggctgcgttcaaagcgtggtggaaagcatcgtttatgcggatagttttcatgacacaaaaaacgcttttgatgcgattgtagtggctaggggtggggggagcatggaggatttgtattctttcaatgatgaaaaaatcgctgatgctctgtatttggccaaaaccttcagcatgtcagctattgggcatgagagcgattttttattgagcgatttagtggcggatttaagggcttctacgccttcaaacgcgatggaaattttactccccagcagcgatgaatggttgcaaagacttgatgggtttaatgtgaaattgcaccgctcgtttaaaactttgctccaccaaaaaaaggcgcatttagagcatttagtggcttctttaaaacgattgagttttgaaaacaagcaccatttaaacgctttaaaactagaaaaattaaaaatcgccctagaaaataaaactctagaatttttacgctttaaaaaaacgcttttagaaaaaatctctactcaaacattaacaagcccttttttacaaactaaaacagagcgattgaacaggcta

SEQ ID NO: 158 - protein, 344 aa, Helicobacter pylori
TFLQVRVQGEVSNLTIHKVSGHAYFSLKDSQSVIKCVLFKGNANRLKFALKEGQEVVVFGGISVYVPRGDYQINCFEIEPKDIGSLTLALEQLKEKLRLKGYFDEENKLPKPHFPKRVAVITSQNSAAWADMKKIASKRWPMCELVCINTLMQGEGCVQSVVESIVYADSFHDTKNAFDAIVVARGGGSMEDLYSFNDEKIADALYLAKTFSMSAIGHESDFLLSDLVADLRASTPSNAMEILLPSSDEWLQRLDGFNVKLHRSFKTLLHQKKAHLEHLVASLKRLSFENKHHLNALKLEKLKIALENKTLEFLRFKKTLLEKISTQTLTSPFLQTKTERLNRL

SEQ ID NO: 159 - DNA, 363 bp, Helicobacter pylori
  CDS (1)..(363)
atcatcaaaggcgggttcattgcgttgagtcaaatgggtgacgcgaacgcttctatccctaccccacaaccagtttattacagagaaatgttcgctcatcatggtaaagccaaatacgatgcaaacatcacttttgtgtctcaagcggcttatgacaaaggcattaaagaagaattagggcttgaaagacaagtgttgccggtaaaaaattgcagaaacatcactaaaaaagacatgcaattcaacgacactaccgctcacattgaagtcaatcctgaaacttaccatgtgttcgtggatggcaaagaagtaacttctaaaccagccaataaagtgagcttggcgcaactctttagcattttc

SEQ ID NO: 160 - protein, 121 aa, Helicobacter pylori
IIKGGFIALSQMGDANASIPTPQPVYYREMFAHHGKAKYDANITFVSQAAYDKGIKEELGLERQVLPVKNCRNITKKDMQFNDTTAHIEVNPETYHVFVDGKEVTSKPANKVSLAQLFSIF

SEQ ID NO: 161 - DNA, 717 bp, Helicobacter pylori
  CDS (1)..(717)
cggactaataaagccttgtatcaattcattttgagaatagctcaaaaagacaattttgcttcagcgtatctaacagtcaaattagaatacccacaaagacacgaagtctctagcgttattgaagaggagttaaaaaagagagaagaagcaaagaggcagaaagaattgattaagcaagaaaatcttaacaccacagcctacatcaatagagtgatgatggcgagcaatgaacagattatcaacaaagaaaaaataagagaagaaaagcaaaaaattatcttagatcaagcaaaggcgctagagactcaatatgtgcataatgccttaaaaagaaaccccgtgcctagaaactacaactactaccaagcgcctgaaaaacgctctaaacatattatgccctctgaaatttttgatgatggcacattcacttattttggtttcaaaaacatcactctccaacctgctatttttgtggttcaacctgatgggaaattgagcatgactgatgccgccattgatcctaacatgaccaattcaggattgagatggtatagagttaatgaaattgcagaaaaatttaagctcattaaagacaaagcccttgtaacagtaatcaataaaggctatgggaaaaatccattgacaaaaaattacaatatcaaaaactatggtgaattggagcgtgtgattaaaaagctccctcttgtcagagataaa

SEQ ID NO: 162 - protein, 239 aa, Helicobacter pylori
RTNKALYQFILRIAQKDNFASAYLTVKLEYPQRHEVSSVIEEELKKREEAKRQKELIKQENLNTTAYINRVMMASNEQIINKEKIREEKQKIILDQAKALETQYVHNALKRNPVPRNYNYYQAPEKRSKHIMPSEIFDDGTFTYFGFKNITLQPAIFVVQPDGKLSMTDAAIDPNMTNSGLRWYRVNEIAEKFKLIKDKALVTVINKGYGKNPLTKNYNIKNYGELERVIKKLPLVRDK

SEQ ID NO: 163 - DNA, 1077 bp, Helicobacter pylori
  CDS (1)..(1077)
gaaggcactaaagagcttggtgcggtggggtttgcgcaacttttagagcaaaaagcgatcagtttgaatgtggataccagcacagaagatttgcaaatcactttagaatttttaaaagaatacgaagatgaagccattacgcgcttaaaagagcttttaaaatcccctaatttcacgcaaaacgctttagaaaaagtcaaaacccaaatgttagccgcacttttacaaaaagaaagcgattttgactatttggctaaattgactttaaagcaagagctttttgctaacacccctttagctaacgcagccttaggcactaaagagagcattcaaaaaatcaagctagacgatttgaaacagcaatttgctaaggtctttgaactcaataagctcgtggtggtgcttgggggcgatttgaaaatcgatcaaacccttaagcgtttgaataacgcccttaatttcttgccacaaggtaaagcgtatgaagagccttattttgaaacgagcgataaaaaaagcgaaaaagtcctctataaagacactgagcaggctttcgtgtattttggtgcgccctttaaaatcaaggatttaaaacaggatttagcgaaatctaaagtcatgatgtttgtgcttggtggggggtttggctctcgtttaatggaaaaaatcagggttcaagagggattagcttatagcgtgtatatccgctccaatttttctaaagtggcgcattttgcgagcgggtatttgcaaaccaagctcagcactcaaactaaaagcgttgccttagttaaaaaaatcgttaaggaatttatagaaaaaggcatgacgcaacaagaattagacgacgctaaaaagtttttactaggctctgagcctttaaggaatgaaacgatctctagccgcttgaacaccacttacaattatttttatttaggtttgcctttaaattttaaccaaacgctgctcaatcaaatccaaaaaatgagtttgaaagaaatcaatgatttcattaaagcccacaccgaaatcaacgacttgacttttgctattgtgagcaataaaaagaaggacaaa

SEQ ID NO: 164 - protein, 359 aa, Helicobacter pylori
EGTKELGAVGFAQLLEQKAISLNVDTSTEDLQITLEFLKEYEDEAITRLKELLKSPNFTQNALEKVKTQMLAALLQKESDFDYLAKLTLKQELFANTPLANAALGTKESIQKIKLDDLKQQFAKVFELNKLVVVLGGDLKIDQTLKRLNNALNFLPQGKAYEEPYFETSDKKSEKVLYKDTEQAFVYFGAPFKIKDLKQDLAKSKVMMFVLGGGFGSRLMEKIRVQEGLAYSVYIRSNFSKVAHFASGYLQTKLSTQTKSVALVKKIVKEFIEKGMTQQELDDAKKFLLGSEPLRNETISSRLNTTYNYFYLGLPLNFNQTLLNQIQKMSLKEINDFIKAHTEINDLTFAIVSNKKKDK

SEQ ID NO: 165 - DNA, 882 bp, Helicobacter pylori
  CDS (1)..(882)
gaagaggatgggaatgaaagtattgcctatgatttttcaagcgctaaggagttgctagaattgtgccaaaaacaccaaaaaagcatcgctgaaatcgtgcgtttgagagaaaacgccctgaaaaaccaccctgatgcaacgatggttaaaatttatcatgcgatgcttgagtgttatgataatggggctaattctaaagaaaggtatctgcctggttctttgaaagtaacacgattggccccaagcattaaaacgcgcctagaaaaacaccccacaagcgggaaagaccccttagccttgattgattacatttcgctttacgctcgcgccattgctgaagaaaacgctagcggaggcaaggtggtaaccgcccccactaatggggcgtgcgcggtggtgccaagcgtgcttttatacgctaaaaaccatttgtttgaaaatttatcgcaaaaggctatcaatgattttttactcactagtgcggcgattggctatctttacaagaaaaacgcttccttgagtggcgcagaagccgggtgtcaggctgaaattggcgtggcaagctctatggctgcgggggggttagctcatttgtgccaagcgaccacgcaacaggttttgatcgctagtgaaatcgctatggaacaccatttaggattgacatgcgatccggtggggggcttggtgcaaatcccttgcattgaacgcaatgttttaggggcgattaaagcgatcagcgcttctaaactagccttagaagatgaatacaagcctaaagtgagtctggatgaagtgatcgctacaatgtatgcgaccggaaaagacatgaatgaaaaatacaaagagacttcgttaggggggttagccaaaaccttaaaatgc

SEQ ID NO: 166 - protein, 294 aa, Helicobacter pylori
EEDGNESIAYDFSSAKELLELCQKHQKSIAEIVRLRENALKNHPDATMVKIYHAMLECYDNGANSKERYLPGSLKVTRLAPSIKTRLEKHPTSGKDPLALIDYISLYARAIAEENASGGKVVTAPTNGACAVVPSVLLYAKNHLFENLSQKAINDFLLTSAAIGYLYKKNASLSGAEAGCQAEIGVASSMAAGGLAHLCQATTQQVLIASEIAMEHHLGLTCDPVGGLVQIPCIERNVLGAIKAISASKLALEDEYKPKVSLDEVIATMYATGKDMNEKYKETSLGGLAKTLKC

SEQ ID NO: 167 - DNA, 177 bp, Helicobacter pylori
  CDS (1)..(177)
gagcaagcggttaaaatcgtggaaaaacgcttgaaaaaagagggcatgaaattgagcgattttaacgaagaagaattgaaaatcatgtttgaagcggaagagaaaaggcttttagaacaaatccaaactaagcattttaaagaagtttgggaaaagggcgacaatgagcaaggaaaa

SEQ ID NO: 168 - protein, 59 aa, Helicobacter pylori
EQAVKIVEKRLKKEGMKLSDFNEEELKIMFEAEEKRLLEQIQTKHFKEVWEKGDNEQGK

SEQ ID NO: 169 - DNA, 971 bp, Helicobacter pylori
  CDS (1)..(969)
gttatcactaatcgtggagggcgcacttgccatgccgctattgtggcgagagaaattggcgtgccagctatcgttggggtgagcggggcgactgatagcctttataccggcatggaaatcacggtttcttgcgctgagggcgaagagggctatgtgtatgcgggcatttatgagcatgaaattgaaagggtggagctttctaacatgcaagaaactcaaacaaaaatttacatcaatattggaaaccctgaaaaagcctttggcttttctcaactccctaatcacggcgtagggctagccaggatggaaatgattattttaaatcaaatcaaagcccaccctttagctttagtggatttgcaccacaaaaaaagcgtgaaagaaaaaaatgaaattgaaaacctcatggcaggctatgctaaccctaaagatttttttgtgaaaaaaatcgctgaaggcattggcatgatcagtgcagcgttttaccctaaacctgtcattgtgagaacgagcgatttcaaatccaatgaatacatgcgcatgcttggcggctctagctatgagcctaatgaagaaaaccccatgcttggctataggggggctagtcggtattattcagagagctataatgaagcgttttcgtgggagtgtgaagccttagcgttagtgagggaagaaatgggattaaccaacatgaaagtgatgatcccttttttgcgaaccattgaagagggtaaaaaagtcctagaaatcttaagaaaaaacaatttagaatccggtaaaaacgggcttgaaatttatatcatgtgcgaattgccggtgaatgtcattttggctgatgatttcttgagcttgtttgatggcttttctattggatcaaacgatttaacccagctcactttaggcgtggatagagacagcgaattggtcagccatgtctttgatgaaaggaatgaagcgatgctaaagat

SEQ ID NO: 170 - protein, 323 aa, Helicobacter pylori
VITNRGGRTCHAAIVAREIGVPAIVGVSGATDSLYTGMEITVSCAEGEEGYVYAGIYEHEIERVELSNMQETQTKIYINIGNPEKAFGFSQLPNHGVGLARMEMIILNQIKAHPLALVDLHHKKSVKEKNEIENLMAGYANPKDFFVKKIAEGIGMISAAFYPKPVIVRTSDFKSNEYMRMLGGSSYEPNEENPMLGYRGASRYYSESYNEAFSWECEALALVREEMGLTNMKVMIPFLRTIEEGKKVLEILRKNNLESGKNGLEIYIMCELPVNVILADDFLSLFDGFSIGSNDLTQLTLGVDRDSELVSHVFDERNEAMLK

SEQ ID NO: 171 - DNA, 459 bp, Helicobacter pylori
  CDS (1)..(459)
attttagcggacgacagagccacgactttagaggtgatggcctatcacatggaagaattagaattaaaagatgaagatattgcgtgttgtttgtatggcgcttcagcgcttttacaagaaaagcatttaaaaaacgcttttgaaactttaaacaaaaaccaaaatacggattatgttttcacatgctctccatttagcgcttcgccctatcgttcttttagtcttgaaaacggcgttcaaatggcttttaaagagcattcaaacacgcgcacgcaagatttaaaaacgctctatcatgacgcggggttgctttatatggggaaggctcaagcctttaaagaaatgcggcctatttttagtcaaaattctatcgctttagaattatcgcccttagaagtccaagatattgcacactttagaagatttagaattagccaagctcaaatacagccgtttgaa

SEQ ID NO: 172 - protein, 153 aa, Helicobacter pylori
ILADDRATTLEVMAYHMEELELKDEDIACCLYGASALLQEKHLKNAFETLNKNQNTDYVFTCSPFSASPYRSFSLENGVQMAFKEHSNTRTQDLKTLYHDAGLLYMGKAQAFKEMRPIFSQNSIALELSPLEVQDIAHFRRFRISQAQIQPFE

SEQ ID NO: 173 - DNA, 432 bp, Helicobacter pylori
  CDS (1)..(432)
gagcagaaattcactgaatctaagagttacatggaatggattaaaggcctttatgaaaaaagcgatggccctactttgaaatcgtttgatcagttttggagggatggttttgtggagtttgaaatccctgaaaatgcgagaaagtttgtgcgtcatgcgaaattcaggcaagaccctattaacaataagctggatacagagagtgggaaaattcaaattttttctcaaaaatgcgcggattttaaactggccgattttaaagggcatcctacttggtttgagccagctgagtggctaggctctaaaatggctgagatttatccgttccatttaatctctccgcacccaaaataccgtgtcaattcacagcttgataacacttgggttaggaatgtgtataaaattcaaggcagagagcctgtaatgatcaat

SEQ ID NO: 174 - protein, 144 aa, Helicobacter pylori
EQKFTESKSYMEWIKGLYEKSDGPTLKSFDQFWRDGFVEFEIPENARKFVRHAKFRQDPINNKLDTESGKIQIFSQKCADFKLADFKGHPTWFEPAEWLGSKMAEIYPFHLISPHPKYRVNSQLDNTWVRNVYKIQGREPVMIN

SEQ ID NO: 175 - DNA, 1117 bp, Helicobacter pylori
  CDS (1)..(1116)
cgcacgcttgaattgagcggctatgaagtgatgctagtaaggaatttcacagatattgacgataagatcatcaacaaagccctaaaagaaaacaaaagcattcaagaattaagcagcatttatattgaatcttacacgagggatttgaacgctttgaacgtgaaaaaacccagcctagagcctaaagcgagcgagtatttagacgctatggtgggcatgattgaaacgcttttagaaaaaaatatcgcttatcaggtctctaatggggatatttatttagacacgagcaaggataaagattacggctctttgagcgtgcataatagcagcattgaatttggccgtattggtttggtgcaagaaaaacggcttgagcaggattttgtgttatggaaaagctataagggggataatgatgtgggctttgatagccctttaggcaaagggcgccctggctggcatatagaatgctctagcatggtttttgaaactttagcgctcactaacaccccctatcaaattgatatccatgcaggcggagcggatttgttattcccccaccatgaaaatgaagcgtgccaaacccgttgcgcctttggcgtggagcttgccaaatattggatgcataacggctttgtgaatatcaataacgaaaaaatgtctaaaagtttggggaatagcttttttgttaaagacgctctcaaaaactatgatggcgaaattttgcgcaattacttactaggggtgcattatcgctctgttttgaatttcaatgaagaagacttgttagtgagtaaaaaacgcttggataaaatctatcgtttaaaacagcgcgttttagggactcttggaggaataaatccaaactttaaaaaagaaattttagagtgcatgcaagatgatttaaacgtttctaaagcgttgagcgttttagaaagcatgctttcttccactaatgaaaaattggatcaaaaccctaaaaacaaggctttaaagggcgaaattttagcgaatttgaaattcatagaagaactgcttggcatcgggtttaaagaccctagcgcctatttccaattaggcgtgagtgaaagcgaaaaacaagaaattgaaaacaaga

SEQ ID NO: 176 - protein, 372 aa, Helicobacter pylori
RTLELSGYEVMLVRNFTDIDDKIINKALKENKSIQELSSIYIESYTRDLNALNVKKPSLEPKASEYLDAMVGMIETLLEKNIAYQVSNGDIYLDTSKDKDYGSLSVHNSSIEFGRIGLVQEKRLEQDFVLWKSYKGDNDVGFDSPLGKGRPGWHIECSSMVFETLALTNTPYQIDIHAGGADLLFPHHENEACQTRCAFGVELAKYWMHNGFVNINNEKMSKSLGNSFFVKDALKNYDGEILRNYLLGVHYRSVLNFNEEDLLVSKKRLDKIYRLKQRVLGTLGGINPNFKKEILECMQDDLNVSKALSVLESMLSSTNEKLDQNPKNKALKGEILANLKFIEELLGIGFKDPSAYFQLGVSESEKQEIENK

SEQ ID NO: 177 - DNA, 673 bp, Helicobacter pylori
  CDS (1)..(672)
gaggctaataagcaagacgctttattgcaagctttaaaagatgaagccaaccataaaaaagaaagagaaaaaagagaagttaaacaagaagaagaaattaaagacatcaatctgcaattaagcaaaatcagagacagcctgaaactcattcaaaacatgttttgggatgagaaaaaccccaattctattaatatccctcaagaatttgcagaaatttacaaactggccaaacaaagtgggatgaaacccagccatttagatgaaatcatgcaattgagcctggaattgatgcctttacgcatgcgcgaaaattccgtaacgattaagcgttattttagagaagtgttgcgcaaaatgatcttgtgttgccctgaagatttgaatttaaggcaaaaacgcatcttaatgcttgtagggccaacaggcgtggggaaaacgacgactttagctaaattagccgcgcgctattctaggatgttagctaaaaaatacaaggtgggcattatcactttagacaattatcgcattggggctttggagcaattaagctggtatgctaataaaatgaaaatgagtatagaagcggtgattgacgctaaggattttgctaaagaaattgaagcgttggaatactgcgattttattttagtggatacgacagggcattcgcaat

SEQ ID NO: 178 - protein, 224 aa, Helicobacter pylori
EANKQDALLQALKDEANHKKEREKREVKQEEEIKDINLQLSKIRDSLKLIQNMFWDEKNPNSINIPQEFAEIYKLAKQSGMKPSHLDEIMQLSLELMPLRMRENSVTIKRYFREVLRKMILCCPEDLNLRQKRILMLVGPTGVGKTTTLAKLAARYSRMLAKKYKVGIITLDNYRIGALEQLSWYANKMKMSIEAVIDAKDFAKEIEALEYCDFILVDTTGHSQ

SEQ ID NO: 179 - DNA, 43 bp, Helicobacter pylori
  CDS (1)..(42)
gactataaagatttagacatgctcaagcacacgctatcagagc

SEQ ID NO: 180 - protein, 14 aa, Helicobacter pylori
DYKDLDMLKHTLSE

SEQ ID NO: 181 - DNA, 238 bp, Helicobacter pylori
  CDS (1)..(237)
gagcgcctagaaaaagaaattgaagtcattacgaacatgaaattcccagggtatatgctgattgtgtgggattttatccgttatgctaaggaaatgggcattcctgtagggcctggtagggggagtgcggccgggagcttggtggcttttgctttaaaaatcacggatattgaccctttgaaatacgatttgctctttgaaaggtttttaaaccccgaaagaatcagcatgcctgata

SEQ ID NO: 182 - protein, 79 aa, Helicobacter pylori
ERLEKEIEVITNMKFPGYMLIVWDFIRYAKEMGIPVGPGRGSAAGSLVAFALKITDIDPLKYDLLFERFLNPERISMPD

SEQ ID NO: 183 - DNA, 1588 bp, Helicobacter pylori
  CDS (1)..(1587)
aatttagggaatgcaaacaacaccatttactattacgacaagagcattgatttttatgcgagcgggaaaactctattcactaaagcggaattttctcaaacattcaccgggcaaaacagcgcgatcgtttttggggctaaaagcatatggacgagcttaagcgatgcaccgcagtctaacaccatcattcgctttggggacaataagggagcagggagtaatgatgcgagcgggcattgctggaatttgcaatgcataggctttattacagggcattatgaagcgcaaaagatttacatcaccggtagcattgaaagcgggaatcgcatttctagcggtgggggcgcgagccttaattttaacgggcttcaaggcattcttttaacgaacgcgactttgtataaccgcgccgctggcacgcaaagctcgtctatgaattttatctctaacagcgcgaacattcaggctcaaaactcctattttatagacgataccgcacaaaatggcggtaaccctaatttcagtttcaacgctttgaatctggatttttctaacagctcttttagaggctatgtggggaaaacgcaatctgtttttaaattcaatgccaagaatgcgatcagtttcaccaacagcacgaatttaagctctggtttgtatcaaatgcaagctaaaagcgtgttgtttgacaattccaatttaagcgtttcagtggggacaagcagtattaaagccaatgcgatcaatctttctcaaaatgcctctattaatgcgagcaaccattcaaccttagaacttcaaggcgatttgaatgtgaacgacaccagctcgctcaacctcaaccaaagcacgattaatgtttccaataacgccacgatcaacgattatgcgagcttgattgcgagtaatggctctcaccttaattttaacggggcggttaatttcaattcagcgaatattactacgagtttgaataattcctctatcgtgtttaagggggcggtctctttaggagggcagtttaatttaagcaataactcttctttagatttccaaggctctagcgctatcacctctaacacggcgtttaatttctatgataacgctttttctcaaagccccatcactttccatcaagcccttgacattaaagcgcccttaagtttgggaggcaaccttttaaaccctaacaacagcagcgtgctggatttaaaaaacagccagcttgtttttggcgatcaagggagtttgaatatcgctaacattgatttactaagcgatctaaatgataataaaaatcgtgtgtataacatcattcaagcggacatgaatagtaattggtatgagcgtatcagcttctttggcatgcacatcaatgacgggatttatgatgctaaaaaccaaacttatagtttcactaacccccttaataacgccctaaaaatcaccgagagctttaaagacaaccaactaagcgttacgctctctcaaatcccgggtattaaaaacacgctctataacattggctctgaaatttttaactaccaaaaagtttataacaacgctaatggcgtgtattcttatagcg

SEQ ID NO: 184 - protein, 529 aa, Helicobacter pylori
NLGNANNTIYYYDKSIDFYASGKTLFTKAEFSQTFTGQNSAIVFGAKSIWTSLSDAPQSNTIIRFGDNKGAGSNDASGHCWNLQCIGFITGHYEAQKIYITGSIESGNRISSGGGASLNFNGLQGILLTNATLYNRAAGTQSSSMNFISNSANIQAQNSYFIDDTAQNGGNPNFSFNALNLDFSNSSFRGYVGKTQSVFKFNAKNAISFTNSTNLSSGLYQMQAKSVLFDNSNLSVSVGTSSIKANAINLSQNASINASNHSTLELQGDLNVNDTSSLNLNQSTINVSNNATINDYASLIASNGSHLNFNGAVNFNSANITTSLNNSSIVFKGAVSLGGQFNLSNNSSLDFQGSSAITSNTAFNFYDNAFSQSPITFHQALDIKAPLSLGGNLLNPNNSSVLDLKNSQLVFGDQGSLNIANIDLLSDLNDNKNRVYNIIQADMNSNWYERISFFGMHINDGIYDAKNQTYSFTNPLNNALKITESFKDNQLSVTLSQIPGIKNTLYNIGSEIFNYQKVYNNANGVYSYS

SEQ ID NO: 185 - DNA, 1735 bp, Helicobacter pylori
  CDS (1)..(1734)
gctgatcgcaccacgagagtggatttcaacgctaaaaatatcttaattgataattttttagaaatcaataatcgtgtgggttctggagccgggaggaaagccagctctacggttttaactttgcaagcttcagaagggattactagcagtaaaaatgcggaaatttctctttatgatggcgccacgctcaatttggcttcaaacagcgttaaattaatgggtaatgtgtggatgggccgtttgcaatatgtgggagcgtatttggccccttcatacagcacgataaacacttcaaaagtgacaggggaagtgaattttaaccatctcactgtgggcgatcacaacgccgctcaagcaggcattatcgctagtaacaagactcatattggcacactggatttgtggcaaagcgcgggactaaacattatcgcccctccagaaggcggttataaggataaacctaaggataaacctagtaacaccacgcaaaataatgctaacaacaaccaacaaaacagcgctcaaaacaatagtaacactcaggttattaacccacccaatagcgcgcaaaaaacagaaattcaacccacgcaagtcattgatgggccttttgctggtggcaaagacacggttgtcaatattgatcgcatcaacactaacgctgatggcacgattaaagtgggagggtataaagcttctcttaccaccaatgcggctcatttgcatatcggcaaaggcggtatcaatctgtccaatcaagcgagcgggcgcacccttttagtggaaaatctaaccgggaatatcaccgttgatgggcctttaagagtgaataatcaagtgggtggttatgctttggcaggatcaagcgcgaattttgagtttaaggctggtacggataccaaaaacggcacagccacttttaataacgatattagtttgggaagatttgtgaatttaaaagtggatgctcatacagctaattttaaaggtattgatactggtaatggtggtttcaacaccttagattttagtggcgttacaggtaaggtcaatatcaacaagctcattacggcttccactaatgtggccgttaaaaacttcaacattaatgaattggttgttaagaccaatggggtgagtgtgggggaatacactcattttagcgaagatataggcagtcaatcgcgcatcaataccgtgcgtttggaaactggcactaggtcaatcttttctgggggtgtcaaatttaaaagcggtgaaaaactggttatagatgagttttactatagcccttggaattattttgacgctaggaatattaaaaatgttgaaatcaccagaaaattcgcttcttcaaccccagaaaacccttggggcacatcaaagcttatgtttaataatctaaccctgggtcaaaatgcggtcatggactatagtcaattttcaaatttaaccattcagggggatttcatcaacaatcaaggcactatcaattatttggtccgaggcgggcaagtagccaccttgaatgtaggcaatgcggcagctatgttctttagtaataatgtggatagcgcgactgggttttaccaaccgctcatgaagattaacagcgctcaagatctcattaaaaataaagaacatgtcttattgaaagcgaaaatcatcggttatggcaatgtttctttaggcactaacagcattagtaatgttaatctaatagagcaattcaaag

SEQ ID NO: 186 - protein, 578 aa, Helicobacter pylori
ADRTTRVDFNAKNILIDNFLEINNRVGSGAGRKASSTVLTLQASEGITSSKNAEISLYDGATLNLASNSVKLMGNVWMGRLQYVGAYLAPSYSTINTSKVTGEVNFNHLTVGDHNAAQAGIIASNKTHIGTLDLWQSAGLNIIAPPEGGYKDKPKDKPSNTTQNNANNNQQNSAQNNSNTQVINPPNSAQKTEIQPTQVIDGPFAGGKDTVVNIDRINTNADGTIKVGGYKASLTTNAAHLHIGKGGINLSNQASGRTLLVENLTGNITVDGPLRVNNQVGGYALAGSSANFEFKAGTDTKNGTATFNNDISLGRFVNLKVDAHTANFKGIDTGNGGFNTLDFSGVTGKVNINKLITASTNVAVKNFNINELVVKTNGVSVGEYTHFSEDIGSQSRINTVRLETGTRSIFSGGVKFKSGEKLVIDEFYYSPWNYFDARNIKNVEITRKFASSTPENPWGTSKLMFNNLTLGQNAVMDYSQFSNLTIQGDFINNQGTINYLVRGGQVATLNVGNAAAMFFSNNVDSATGFYQPLMKINSAQDLIKNKEHVLLKAKIIGYGNVSLGTNSISNVNLIEQFK

SEQ ID NO: 187 - DNA, 666 bp, Helicobacter pylori
  CDS (1)..(666)
agttttttggtaagctttttggttgctgaaaacgctcatgagccagaagaaatcaaggctaaagtggcttatgtgaaaatcccccaattagaagatttggaaaacaacccggtttatatcggtcaaattataggcgtaacttatgatttattgctgtttgacgctgagtttttggaagccaaaatcaaagacgggttggataaaacccaaattgagcttttaaacaagatgcctaaatggaaaaaggtggaaaaagagcttttcagagcgacttattattacaagattaagggcataaaagcgattattccgtccttagaagtgagcgcgttttccaataaagacaaatacatagatcattccatagccccaaaagttactttgcaggtaacggatttgtccaaaaaccctcgttatgcgaatgtcatggctaaagatttacaagtcttgcaatacaaaaccaaagattatgacgataaaaacaatattttggtgatggaaatagcgttcaaagaagccacttgggaagattttcacatcaaagaagcgatcaagcaagggtttgataacgcctctttaaaccagatcaaggctaaagaagggagcgttttttattattgcgtgttgcctaagactattcaaaacctttcttttgattatttctcg

SEQ ID NO: 188 - protein, 222 aa, Helicobacter pylori
SFLVSFLVAENAHEPEEIKAKVAYVKIPQLEDLENNPVYIGQIIGVTYDLLLFDAEFLEAKIKDGLDKTQIELLNKMPKWKKVEKELFRATYYYKIKGIKAIIPSLEVSAFSNKDKYIDHSIAPKVTLQVTDLSKNPRYANVMAKDLQVLQYKTKDYDDKNNILVMEIAFKEATWEDFHIKEAIKQGFDNASLNQIKAKEGSVFYYCVLPKTIQNLSFDYFS

SEQ ID NO: 189 - DNA, 186 bp, Helicobacter pylori
  CDS (1)..(186)
ggagccaagagcgttctagtcgctaatatcatggtcgttcaaacccccattgagctttccaccgtgaattatttagcccctttaattttcaatttggacaagcagctcatggggcaagtggttttggattctaacaaatacccacactaccatttaagagagaatattctaagccacacgcatgaa

SEQ ID NO: 190 - protein, 62 aa, Helicobacter pylori
GAKSVLVANIMVVQTPIELSTVNYLAPLIFNLDKQLMGQVVLDSNKYPHYHLRENILSHTHE

SEQ ID NO: 191 - DNA, 864 bp, Helicobacter pylori
  CDS (1)..(864)
gataagggattaaaaaaggtgttcaaagacagcaaaaaagacgcttgcgggttcatctatgagatcagcgagttcatgaaagcctataccgcattgctaaaaaaacaagaccgatacgtctatttattgaggtatctcccctctaggtattgggccagcattttaacgactgccctttatgtcaaataccctgattttgacgctttgaaaaagcttttggtgtcttattattaccaaacttggattgcaggaggcacgatcacgcgcatcaagcaaaccagtatcaacattatcaaaaacgttaaaagcaataagagcgttgaaaccatcaaagagcttatattgaatagcatcgactcttataacacctttgatcaatacctctataacttatgggatagctcttctgtttatcatagcaaatgggtgcgtcctgtcttagccctagctaattatttcatggcagatgaagagaaaccccattttatcgctatggatgccgaaacccaagtggagcatattttgccacaaacgcccaaaagaggcagtcaatggaacgcggattttgacaaagaaaaaagagaagaatgggtaaataatatcgcgaatttaacccttttaaagcgtaaaaagaacgcgcatgctttaaacggggattttgatgaaaaaagaaaaatttatggaggcaaagacacgagcaaagtgattagctgttatgacatcactaaagaattgtatagcaattataggaagtggaatgagaagtccctccaagagcgatacaaatctttgtataacactatcacgcctgttttacacatagaggggcaagaagatgattttgaagatgattttgatctagaa

SEQ ID NO: 192 - protein, 288 aa, Helicobacter pylori
DKGLKKVFKDSKKDACGFIYEISEFMKAYTALLKKQDRYVYLLRYLPSRYWASILTTALYVKYPDFDALKKLLVSYYYQTWIAGGTITRIKQTSINIIKNVKSNKSVETIKELILNSIDSYNTFDQYLYNLWDSSSVYHSKWVRPVLALANYFMADEEKPHFIAMDAETQVEHILPQTPKRGSQWNADFDKEKREEWVNNIANLTLLKRKKNAHALNGDFDEKRKIYGGKDTSKVISCYDITKELYSNYRKWNEKSLQERYKSLYNTITPVLHIEGQEDDFEDDFDLE

SEQ ID NO: 193 - DNA, 417 bp, Helicobacter pylori
  CDS (1)..(417)
agtgcagaaatttttgacaagagggcgatagactatgagagcctcttttcacgcaaaaatagggcgcgaaattttatgccaagaatgccaaaagattcgcactcgcaaggctttgagactttaagcattaattttgaaggcacgatggagtggagcgcgtttgggatttggctgagtttgttattgcatcaatacggcacacagattttacgcatcaaggggattattgacattggaagcggctttttggtgagtattaacggcgtgatgcatgtcatttacccgcctaagcatattttaaaggatcaaaacggctctaacctcgtttttatcatgcgccatttagagcgtgaaaaaatcttaaattccttaaagggttttaaggattttctcggcatcaagggttttgaaacccaa

SEQ ID NO: 194 - protein, 139 aa, Helicobacter pylori
SAEIFDKRAIDYESLFSRKNRARNFMPRMPKDSHSQGFETLSINFEGTMEWSAFGIWLSLLLHQYGTQILRIKGIIDIGSGFLVSINGVMHVIYPPKHILKDQNGSNLVFIMRHLEREKILNSLKGFKDFLGIKGFETQ

SEQ ID NO: 195 - DNA, 615 bp, Helicobacter pylori
  CDS (1)..(615)
cattcttttgggctagaaacttacatccagcaaaaaaaggttaccaataaagaaagcgctttagaatatttaaaagccaatctctctagccagttcctttacacggaaatgctgagcttgaaattaacctatgaaagcgccctccaacaagatttaaaaaagatcttaggggttgaagaagtcattatgctatccacaagccccatggaattacgattagccaatcaaaagctgggcaatcgtttcattaaaaccttacaagccatgaacgaattagacatgggcgaattttttaacgcttacgctcaaaaaaccaaagatcccacccatgccactagctatggcgtttttgcggcaagtttggggattgaattgaaaaaggctttaaggcattatctttatgcgcaaacttctaacatggtgatcaactgcgttaaaagcgtccctttatctcaaaacgacgggcaaaaaatcttattgagcttgcaaagcccttttaaccagctcatagaaaaaaccctagaactagacgaaagccacctgtgcacggcaagcgttcaaaacgacattaaggcgatgcagcatgagagtttatactcgcgcctttatatgtct

SEQ ID NO: 196 - protein, 205 aa, Helicobacter pylori
HSFGLETYIQQKKVTNKESALEYLKANLSSQFLYTEMLSLKLTYESALQQDLKKILGVEEVIMLSTSPMELRLANQKLGNRFIKTLQAMNELDMGEFFNAYAQKTKDPTHATSYGVFAASLGIELKKALRHYLYAQTSNMVINCVKSVPLSQNDGQKILLSLQSPFNQLIEKTLELDESHLCTASVQNDIKAMQHESLYSRLYMS

SEQ ID NO: 197 - DNA, 1121 bp, Helicobacter pylori
  CDS (1)..(1119)
ccttgggctaatggcagcatccctaaatctaacagcacggtgcgttttggggggtatgagggagtcaattgggggaaaacgggctatattactggcactttcacagccgatagggtttatatcaccggtaacatgatgactggtaacggcgctcaaaccggtgggggggcgactttgaattttgtgggcgcgactgaaattaatatcgctggagccacttttaaaaacctaaaaaccacttcacaaaactcttacatgacttttatggcattaggggatagctctgggagcgctaagatcaatgtttctcaatctgatttttacgattggacgggtggggggtatgattttaccggtaatggcgtttttgatagcgtgaatttcaacaaggcttattacaaatttcaaggcactgaaaattcttacaattttaaaaacacgaactttttagcagggaattttaagtttcagggcaagaccaccattgaaaaatccgttttaagcgacgcttcttacacttttgatggcacgaataacacctttactgaagacaagtttaataatggctcgtttaattttagtcatgcagagcagacagacgcttttaataacaactcgtttaatggcggttcgtttagttttaacgccaagcaagtaaattttagtgggaactcgttcaatgggggcgtgtttaatttcaataatacccctaaagtcagtttcactgatgacacttttaatgtgaataaccaattcaaaataaatggtactcaaacaactttcactttcaataagggcgttgttttcaacatgcaagggcttttgagcagtttaagcgtaggcacgacttatcaattgcttaacgctaaaagcgtggattataaggataataacgctttgtatcaaatgctgcgttggattagtggggaaaaccctagcggcacgctagtaaataaggatcagtccgcgccaaacagcgctaaaatttataatgtccatttcaccgataacggcttgacttactacatcaaagaaaattttaataatgggatcacgctcactcgtttatgcactctaggctatacgcattgcgtgaatattgataacgatgcgtttaatct

SEQ ID NO: 198 - protein, 373 aa, Helicobacter pylori
PWANGSIPKSNSTVRFGGYEGVNWGKTGYITGTFTADRVYITGNMMTGNGAQTGGGATLNFVGATEINIAGATFKNLKTTSQNSYMTFMALGDSSGSAKINVSQSDFYDWTGGGYDFTGNGVFDSVNFNKAYYKFQGTENSYNFKNTNFLAGNFKFQGKTTIEKSVLSDASYTFDGTNNTFTEDKFNNGSFNFSHAEQTDAFNNNSFNGGSFSFNAKQVNFSGNSFNGGVFNFNNTPKVSFTDDTFNVNNQFKINGTQTTFTFNKGVVFNMQGLLSSLSVGTTYQLLNAKSVDYKDNNALYQMLRWISGENPSGTLVNKDQSAPNSAKIYNVHFTDNGLTYYIKENFNNGITLTRLCTLGYTHCVNIDNDAFN

SEQ ID NO: 199 - DNA, 679 bp, Helicobacter pylori
  CDS (1)..(678)
cacgcttacaataaagaagtggagttagttttaagcactaatggttttttactcaaaaaaatggctaaggatttaaaaaatgccgggttagcgcaagtgaatgtttcattggattctttaaaaagcgatagggttttaaaaatctctcaaaaagacgctcttaaaaacacgctagaagggattgaagagtctttgaaagtgggtttaaaactcaaattaaacacggttgtgataaaaagcgttaatgatgatgaaatcttagagcttttagaatacgcaaaaaataggcatatacaaatccgctacattgaatttatggaaaacacgcatgctaaaagtttggttaaaggcttgaaagagcgagaaattttagatttgatcgctcaaaaatatcaaatcattgaggcagaaaaacccaaacaagggtcttctaaaatctacacgctagaaaatggctatcaatttggcattatcgctccgcatagcgatgatttttgccaatcttgcaatcgtatccgtttggcttctgatggtaagatttgcccatgtttatactatcaagacgccatagacgctaaagaggcgatcatcaataaggatacaaaaaatataaaaaggcttttaaagcaatctgtcatcaataaaccagaaaaaaacatgtggaatgataaaaacagcg

SEQ ID NO: 200 - protein, 226 aa, Helicobacter pylori
HAYNKEVELVLSTNGFLLKKMAKDLKNAGLAQVNVSLDSLKSDRVLKISQKDALKNTLEGIEESLKVGLKLKLNTVVIKSVNDDEILELLEYAKNRHIQIRYIEFMENTHAKSLVKGLKEREILDLIAQKYQIIEAEKPKQGSSKIYTLENGYQFGIIAPHSDDFCQSCNRIRLASDGKICPCLYYQDAIDAKEAIINKDTKNIKRLLKQSVINKPEKNMWNDKNS

SEQ ID NO: 201 - DNA, 486 bp, Helicobacter pylori
  CDS (1)..(486)
ttttttgtcttggcttttatagatttagcgatcaaacgccgccaatacaccaactctttaaaaatgactaaacaagaagttaaggacgaatacaaacagcaagaagggaacccagaaatcaaagccaaaatccgccaaatgatgctaaaaaacgccacgaataaaatgatgcaagaaatccctaaagccaatgtcgtggttactaaccccacccattacgccgtcgctctcaaatttgatgaagaacaccctgtgcctgtggtagtggctaaaggcacggattatttagccattaggattaagggcatcgctagagagcatgacatagaaattatagaaaataaaacgctcgccagagagctttatagagatgtgaaattaaacgctgccataccagaagaattgtttgaagccgtggcgatagtcttcgctcaagtggctaaattagagcaagaacgccaaaaacaaaagatcattaaacctctt

SEQ ID NO: 202 - protein, 162 aa, Helicobacter pylori
FFVLAFIDLAIKRRQYTNSLKMTKQEVKDEYKQQEGNPEIKAKIRQMMLKNATNKMMQEIPKANVVVTNPTHYAVALKFDEEHPVPVVVAKGTDYLAIRIKGIAREHDIEIIENKTLARELYRDVKLNAAIPEELFEAVAIVFAQVAKLEQERQKQKIIKPL

SEQ ID NO: 203 - DNA, 174 bp, Helicobacter pylori
  CDS (1)..(174)
accggaagaacccatcaaatcagagtccatttaaagcatatcaaccaccccattataggcgatacgctttataataacgagccaagtttagccaaacgcttgatgctccatgcacataaaatcgcgctactagggtatgaatttgaagcgatcgctcctaaagaatttgaaatt

SEQ ID NO: 204 - protein, 58 aa, Helicobacter pylori
TGRTHQIRVHLKHINHPIIGDTLYNNEPSLAKRLMLHAHKIALLGYEFEAIAPKEFEI

SEQ ID NO: 205 - DNA, 69 bp, Helicobacter pylori
  CDS (1)..(69)
caagaaatgcacattcttatgatccacatcttatgcgattgcattgaaaggcatttcgctcataaaaat

SEQ ID NO: 206 - protein, 23 aa, Helicobacter pylori
QEMHILMIHILCDCIERHFAHKN

SEQ ID NO: 207 - DNA, 423 bp, Helicobacter pylori
  CDS (1)..(423)
aggcattatgaaacgatgtttattctcaaacctactttagtagaagaagagattaaatccaagattgagttttataaagaagtgatcactaagcatcacggcgtgattgaaacgagcctggatatgggcatgcgtaatttagcttatgaaatcaaaaagcacaaaagaggctattattatgtggcgtatttcaaagcggagccgtcaatgattgtagagcttgaacgattgtatcgcatcaatgaagacgtgttgcgtttcattgtgatcaaatacgaaagcaagaaagaagtggaagcgtggcatgcgttggtggatagggctaataaaaagccatcgcacgccaaagaaaaacacgaaaaaaccgaacacacgcattctcaccacacagaggaagcagaaagcgtaggatctcatagcgaa

SEQ ID NO: 208 - protein, 141 aa, Helicobacter pylori
RHYETMFILKPTLVEEEIKSKIEFYKEVITKHHGVIETSLDMGMRNLAYEIKKHKRGYYYVAYFKAEPSMIVELERLYRINEDVLRFIVIKYESKKEVEAWHALVDRANKKPSHAKEKHEKTEHTHSHHTEEAESVGSHSE

SEQ ID NO: 209 - DNA, 212 bp, Helicobacter pylori
  CDS (1)..(210)
tcaagcgataacccgctagccgatgagccggatttggattacgctaacatgagcgctgaagaagtggaagcagagattgaacggctgctgaacaaacgccaagaagccgataaagaacgaagagctcaaaaaaaacaagaagccaaacccaaacaagaagttaccccaacaaaagaaacccccaaagcccctaaaaccgaaactaaagctaa

SEQ ID NO: 210 - protein, 70 aa, Helicobacter pylori
SSDNPLADEPDLDYANMSAEEVEAEIERLLNKRQEADKERRAQKKQEAKPKQEVTPTKETPKAPKTETKA

SEQ ID NO: 211 - DNA, 798 bp, Helicobacter pylori
  CDS (1)..(798)
gcagaagaaagtaaagggagtgttgcaaaatataaaatagaagctcaatacagcattgattttgattctgcagaacacacttcacttttcattcccatgccgagtgttgtagcgagcaatgtgcatttacaaggcaatcatgctagctataaaagcatgctcaattttggagtgccttatttgcaagtggattttttaaaaagcactcaaaaaaagcaagtccatttgtcttatgagatcgctagctatcaattgaatgagcgtttgtttgaaacgagcgattttgtagcaatggggcgttatgaaagagacgatgcgagcgtggctaacattgccaaccagcttaagggaacaacccctaaagaaagcgttcgcaatttttatgcgttcatcaagcatgagatgcctaagagacagaaggctttagagggtaaagaaaatttacctaagcgtgagagtttgccctggtttgcaaccatttcaaaagagagcatgtttgtgtccttatgccatgcgtgcgggattaaaagcgctgaagtgcaaggcttgaaactgggtcaaaacagcgtggtgaaaaacgctcctagagtggaagtgtatttgaaagattcatttctagcgtttgattttcaaaataatcacaaggaagtttttatcccgttgaatcgtcataaagacatgcagttagattctgccttattggcgacttttggcgatgcttttgcccttgtggatggtagggatttaggcaattacgagagcaaactttttgaaaaaagagtgtcctatacgattgtc

SEQ ID NO: 212 - protein, 266 aa, Helicobacter pylori
AEESKGSVAKYKIEAQYSIDFDSAEHTSLFIPMPSVVASNVHLQGNHASYKSMLNFGVPYLQVDFLKSTQKKQVHLSYEIASYQLNERLFETSDFVAMGRYERDDASVANIANQLKGTTPKESVRNFYAFIKHEMPKRQKALEGKENLPKRESLPWFATISKESMFVSLCHACGIKSAEVQGLKLGQNSVVKNAPRVEVYLKDSFLAFDFQNNHKEVFIPLNRHKDMQLDSALLATFGDAFALVDGRDLGNYESKLFEKRVSYTIV

SEQ ID NO: 213 - DNA, 170 bp, Helicobacter pylori
  CDS (1)..(168)
tgcatgtttgatggctatacgcattatttgaatttggtgcttgtcaattgccccatagagctctctggtgtgcgagaatgcattgaagaaagcgaaggggtggatggggcagtgagtgaaaccgctagttctcatttatgcgtgaaagctttagcgaaaggctcagaacc

SEQ ID NO: 214 - protein, 56 aa, Helicobacter pylori
CMFDGYTHYLNLVLVNCPIELSGVRECIEESEGVDGAVSETASSHLCVKALAKGSE

SEQ ID NO: 215 - DNA, 717 bp, Helicobacter pylori
  CDS (1)..(717)
ggcgggattgcgtgcgcgaatttgttgcataaaaattcagggatcacgatagatattggagggggtagcaccgagtgcgcgttgattgaaaaaggcaagattaaggacttaatctcgcttgatgttgggacgattcgcattaaagaaatgtttttagacaaagacttagaggtcaaattggctaaagcctttatccaaaaagaagtctctaaactgccctttaaacacaaaaacgcctttggggtgggggggacgatcagagcgttgagtaaggtattgatgaaacgcttttgttaccctattgattctttgcatggctatgaaatagatgcacataaaaatttagcgttcattgaaaaaatcgtcatgctcaaagaagatcaattacggcttttaggggtgaatgaagagcgtttggatagcatcaggagcggggcgttgattttatcagtcgttttggagcatttaaaaacttctttaatgatcactagtggggtgggggtgagagaaggcgtgtttttgagcgatttattgcgccatcattaccataaattcccccccaatatcaacccctctctcatctctttaaaagatcgctttttgccccatgaaaagcacagccaaaaggtcaaaaaagaatgcgtgaaattgtttgaagccttatcgcctttgcataaaatagatgaaaaataccttttccatttaaagattgcgggg

SEQ ID NO: 216 - protein, 239 aa, Helicobacter pylori
GGIACANLLHKNSGITIDIGGGSTECALIEKGKIKDLISLDVGTIRIKEMFLDKDLEVKLAKAFIQKEVSKLPFKHKNAFGVGGTIRALSKVLMKRFCYPIDSLHGYEIDAHKNLAFIEKIVMLKEDQLRLLGVNEERLDSIRSGALILSVVLEHLKTSLMITSGVGVREGVFLSDLLRHHYHKFPPNINPSLISLKDRFLPHEKHSQKVKKECVKLFEALSPLHKIDEKYLFHLKIAG

SEQ ID NO: 217 - DNA, 480 bp, Helicobacter pylori
  CDS (1)..(480)
tcttctttacaaagcgaacacatcaattccccccttgtcccagaagcgatgctagctttagggcaagcgcacatgaaaaagaaagagtatgttttagcgtctttttactttgatgaatacatcaagcgctttgggactaaggacaatgtggattatttgacttttttaaaattgcaatcgcattattacgctttcaaaaaccattctaaagaccaggaatttatctctaattctattgtgagtttaggcgaatttatagaaaaataccctaacagccgttaccgcccctatgtagaatacatgcaaatcaaattcattttagggcaaaatgagctcaatcgcgcgatcgcgaatgtctataaaaaacgccacaagcctgagggcgtgaaacgctatttagaaaggatagatgagactttagaaaaagagactaaacccaaaccatcgcacatgccttggtatgtgttaatttttgattgg

SEQ ID NO: 218 - protein, 160 aa, Helicobacter pylori
SSLQSEHINSPLVPEAMLALGQAHMKKKEYVLASFYFDEYIKRFGTKDNVDYLTFLKLQSHYYAFKNHSKDQEFISNSIVSLGEFIEKYPNSRYRPYVEYMQIKFILGQNELNRAIANVYKKRHKPEGVKRYLERIDETLEKETKPKPSHMPWYVLIFDW

SEQ ID NO: 219 - DNA, 814 bp, Helicobacter pylori
  CDS (1)..(813)
gacagcaaaaaagacgcttgcgggttcatctatgagatcagcgagttcatgaaagcctataccgcattgctaaaaaaacaagaccgatacgtctatttattgaggtatctcccctctaggtattgggccagcattttaacgactgccctttatgtcaaataccctgattttgacgctttgaaaaagcttttggtgtcttattattaccaaacttggattgcaggaggcacgatcacgcgcatcaagcaaaccagtatcaacattatcaaaaacgttaaaagcaataagagcgttgaaaccatcaaagagcttatattgaatagcatcgactcttataacacctttgatcaatacctctataacttatgggatagctcttctgtttatcatagcaaatgggtgcgtcctgtcttagccctagctaattatttcatggcagatgaagagaaaccccattttatcgctatggatgccgaaacccaagtggagcatattttgccacaaacgcccaaaagaggcagtcaatggaacgcggattttgacaaagaaaaaagagaagaatgggtaaataatatcgcgaatttaacccttttaaagcgtaaaaagaacgcgcatgctttaaacggggattttgatgaaaaaagaaaaatttatggaggcaaagacacgagcaaagtgattagctgttatgacatcactaaagaattgtatagcaattataggaagtggaatgagaagtccctccaagagcgatacaaatctttgtataacactatcacgcctgttttacacatagaggggcaagaagatgatt

SEQ ID NO: 220 - protein, 271 aa, Helicobacter pylori
DSKKDACGFIYEISEFMKAYTALLKKQDRYVYLLRYLPSRYWASILTTALYVKYPDFDALKKLLVSYYYQTWIAGGTITRIKQTSINIIKNVKSNKSVETIKELILNSIDSYNTFDQYLYNLWDSSSVYHSKWVRPVLALANYFMADEEKPHFIAMDAETQVEHILPQTPKRGSQWNADFDKEKREEWVNNIANLTLLKRKKNAHALNGDFDEKRKIYGGKDTSKVISCYDITKELYSNYRKWNEKSLQERYKSLYNTITPVLHIEGQEDD

SEQ ID NO: 221 - DNA, 648 bp, Helicobacter pylori
  CDS (1)..(648)
aagtatatcaattcgccccaaagtaagctttttgataaatccagtttgctctatggctatcatttggctaaagaacacatctataaacaaaagcaagtcattgtaacagaggggtatttggatgtgattttattgcaccaggcgggttttaaaaacgccatagccacgcttgggacagctttaacgccatcgcatttgcccttgcttaaaaaaggcgatcccgaaatccttttgagctatgatggggataaggcagggcgaaacgcagcctataaagcgagcttgatgttggctaaagagcaaaggaggggaggggtgattttgtttgaaaacaacctggatccagcggatatgatcgctaatggccagattgaaaccttaaaaaattggctatcgcaccccatggcttttattgagtttgttttaaggcgcatggcggattcctatcttttagacgatcctttagaaaaagataaggctcttaaagaaatgttagggtttttaaaaaacttttccttgcttttacaaagcgaatacaagcccttaatcgctacccttttgcaagcgcctttgcatgttttagggattagagagcgagtctcttttcagcctttttaccccaaaacagaaaaacccaatcgccctcaa

SEQ ID NO: 222 - protein, 216 aa, Helicobacter pylori
KYINSPQSKLFDKSSLLYGYHLAKEHIYKQKQVIVTEGYLDVILLHQAGFKNAIATLGTALTPSHLPLLKKGDPEILLSYDGDKAGRNAAYKASLMLAKEQRRGGVILFENNLDPADMIANGQIETLKNWLSHPMAFIEFVLRRMADSYLLDDPLEKDKALKEMLGFLKNFSLLLQSEYKPLIATLLQAPLHVLGIRERVSFQPFYPKTEKPNRPQ

SEQ ID NO: 223 - DNA, 864 bp, Helicobacter pylori
  CDS (1)..(864)
actcaaatggcttttgattttaatacgcccttgttgcaagtccagcaccaccatgcccactttttagcgagcgtcttagacgcattgttacaagatccgcatttaaatcacccctttataggcattgtctgggatgggagtggggcttatgaaaataagatttatggggcggagtgttttgtgggggatttggaacgcattgaagaaaccgccaggtttgaagaattttggcttttaggggggcaaaaagcgatcaaagagcctagacgcctggttttagaaatcgctttaaaacaccaactcaacaagcttttaaagcgcgttcaaaagcattttaaagaagacgaattagaaattttccaacaaatgcatgacaaaaaaattcaaagcatagccaccaattccatagggcgtttgtttgatatagtagcgtttagtttggatttaacaggaacgattagctttgaagcagagagcgggcaggttttagaaaatctagccttacaaagcgatgagatcgctttttacccttttgaaatcaaaaacagcgtggtgtgtttgaaagaattttatcaagcgtttgaaaaggatttgggcgttttagagcctgaacgcatcgctaagaaattttttaacagcctagtagaaatcattaccgctttaatcgtgccttttaaagagcatgtggtggtgtgcagtgggggcgtgttttgcaaccaattattatgcgaacaattagccaaacgattgagagggctaaagaggcagtattttttccacaagcatttcccccctaatgacagcagtatccctatcggtcaagccttaatggcgtatttcaaccctacaatcatcaaaaaagga

SEQ ID NO: 224 - protein, 288 aa, Helicobacter pylori
TQMAFDFNTPLLQVQHHHAHFLASVLDALLQDPHLNHPFIGIVWDGSGAYENKIYGAECFVGDLERIEETARFEEFWLLGGQKAIKEPRRLVLEIALKHQLNKLLKRVQKHFKEDELEIFQQMHDKKIQSIATNSIGRLFDIVAFSLDLTGTISFEAESGQVLENLALQSDEIAFYPFEIKNSVVCLKEFYQAFEKDLGVLEPERIAKKFFNSLVEIITALIVPFKEHVVVCSGGVFCNQLLCEQLAKRLRGLKRQYFFHKHFPPNDSSIPIGQALMAYFNPTIIKKG

SEQ ID NO: 225 - DNA, 159 bp, Helicobacter pylori
  CDS (1)..(159)
caaggaatcttacctcctaccatcaatcaagaaatgcctgacccagaatgcgatttggattatatccctaatgcggccagagaaaagcgagtggatgcagtgatgagtaactcatttggttttggtggcactaatggtgttgtgattttcaaaaaagcc

SEQ ID NO: 226 - protein, 53 aa, Helicobacter pylori
QGILPPTINQEMPDPECDLDYIPNAAREKRVDAVMSNSFGFGGTNGVVIFKKA

SEQ ID NO: 227 - DNA, 1293 bp, Helicobacter pylori
  CDS (1)..(1293)
tttgggaataagcagttgcaacttcaaatcagtcagaaagattctgagattgcggagttaaaaaaagaagtcaatctttatcaaagccttttaaatttgtgcttgcatgagggttttgtaggtattaaaaacaataaagtcgtttttaaaagtgggaatcttgcaagcttgaacaatttagaagaacaaagcgttcattttaaagaaaatgcagagagcgttaatttacaaggggtttcttattctttaaaaagccaaaatattgatggcgtgcagtatttttcattggctaaaaacacaagttgtgtgggggaataccataaaaatgatttgtttaagactttttgcgcgagcttaaaagaaggcttagagaacgcgcaagaaagcatgcagtatttccatcaagaaaccggtgctcttttaaatgcagctaaaaatggcgaagcgcattctactgaaggattggggacggttaataaaacggggcaagacattgaatcgctttatgaaaagatgcaaaacgccacttcgctagcggactctctcaaccaacggagcaatgaaatcactcaagtcatttctttgattgatgatattgcagaacaaaccaatctattagccctaaatgccgctattgaggccgcgcgagcgggcgagcatgggagagggtttgcggtggtggctgatgaggtgagaaaactcgctgaaaaaacccaaaaagccactaaagaaatcgctgttgtcgttaaaagcatgcaacaagaagcgaacgatattcaaaccaatacccacgatattaattctattgtaagctctattaagggcgatgtggaagagcttaaatccaccgtaaaaaataacatgattgttgcgcaagcggcaaaatacaccatctacaatatcaataaccgggtgttttgcggtttggccaaacttgatcatgtggtctttaaaaacaatctttatggcatggtttttggtctcaattcctttgatattaccagccataagaattgccgtttaggcaaatggtattatgagggcgcgggcaaagagaatttttccaacacttcaggctatagagctttagaaagccaccatgcaagcgtgcatgctgaagctaatgatttggttaaagccgttcaagaagaccacattaccgattcaaaatacctagagcataaagtgcatttaatggaagatagtgctaaacatgttagagaaaatattgataagatgttttacgaaaaacaagatgaactcaataaaatcattgaaaaaattcaaaaaggc

SEQ ID NO: 228 - protein, 431 aa, Helicobacter pylori
FGNKQLQLQISQKDSEIAELKKEVNLYQSLLNLCLHEGFVGIKNNKVVFKSGNLASLNNLEEQSVHFKENAESVNLQGVSYSLKSQNIDGVQYFSLAKNTSCVGEYHKNDLFKTFCASLKEGLENAQESMQYFHQETGALLNAAKNGEAHSTEGLGTVNKTGQDIESLYEKMQNATSLADSLNQRSNEITQVISLIDDIAEQTNLLALNAAIEAARAGEHGRGFAVVADEVRKLAEKTQKATKEIAVVVKSMQQEANDIQTNTHDINSIVSSIKGDVEELKSTVKNNMIVAQAAKYTIYNINNRVFCGLAKLDHVVFKNNLYGMVFGLNSFDITSHKNCRLGKWYYEGAGKENFSNTSGYRALESHHASVHAEANDLVKAVQEDHITDSKYLEHKVHLMEDSAKHVRENIDKMFYEKQDELNKIIEKIQKG

SEQ ID NO: 229 - DNA, 286 bp, Helicobacter pylori
  CDS (1)..(285)
gatttgaatgcgattttagaagatctcaacagcaaacagctattgccagaatacgcttacaaggtttatggcgcagtggtgagtcaaaataaagacggcgtgtgggtcggcgatgaagccaaaacgaaagccagaagaaaagaaattcttgaaaacagaaaggctagatccataccggtaaaacaatggatggagcaagaaagaaacgctatccttgaaaaagaggcttccaaacaggttaagcacatgtatgcgactagctttgatctctcgcctaagtttttga

SEQ ID NO: 230 - protein, 95 aa, Helicobacter pylori
DLNAILEDLNSKQLLPEYAYKVYGAVVSQNKDGVWVGDEAKTKARRKEILENRKARSIPVKQWMEQERNAILEKEASKQVKHMYATSFDLSPKFL

SEQ ID NO: 231 - DNA, 163 bp, Helicobacter pylori
  CDS (1)..(162)
agacgcaatcaaaaaagcgcatcaaagtttatcaactatccctctaagttcttcactctatgctataatctctgttttaaaacattatggaatgttagaagatattcagcaaaacccttccaaaccaaccaatctaaagaaagaaaccattcaaggaacgcat

SEQ ID NO: 232 - protein, 54 aa, Helicobacter pylori
RRNQKSASKFINYPSKFFTLCYNLCFKTLWNVRRYSAKPFQTNQSKERNHSRNA

SEQ ID NO: 233 - DNA, 222 bp, Helicobacter pylori
  CDS (1)..(222)
gacgatcgctcgttttttatcactgattctcgctacactcaagaagctaaagaaagcgttcagcctaaaaatggcgttttagcggaagtggtagaatctagcgatttagtgcaaagcgcgattgatttgattgttaaaagttcggttaaaaaactcttttttgaccccaatcaagtgaatttacaaacctacaagcgtttaaattcagcgcttggggataag

SEQ ID NO: 234 - protein, 74 aa, Helicobacter pylori
DDRSFFITDSRYTQEAKESVQPKNGVLAEVVESSDLVQSAIDLIVKSSVKKLFFDPNQVNLQTYKRLNSALGDK

SEQ ID NO: 235 - DNA, 108 bp, Helicobacter pylori
  CDS (1)..(108)
cttggctacaacatggctttaatggcgatggtcaatattttagccgaaatgaaagcgttccaagaagcccaaaaaaacaaccctaataaccccattaacaatcaaaaa

SEQ ID NO: 236 - protein, 36 aa, Helicobacter pylori
LGYNMALMAMVNILAEMKAFQEAQKNNPNNPINNQK

SEQ ID NO: 237 - DNA, 381 bp, Helicobacter pylori
  CDS (1)..(381)
tctaaagagagcttgatgcatgccattaattcaattagagtgggcatgcattttaaagagttgagtcagattttagagagcactattacagaaaggggctttgtgcctttgaaaggattttgcgggcatggcattggtaaaaaaccccatgaagagccagagatccccaactacctagaaaaaggcgtcaaacctaatagcggccctaaaatcaaagagggcatggtattttgcttagagcctatggtgtgtcaaaaacagggcgagcctaaaatactagcggataagtggagcgtggtttcagtggatgggcttaacacaagccaccatgagcatactatcgccatagttggcaataaagcagtgattcttacggagcgt

SEQ ID NO: 238 - protein, 127 aa, Helicobacter pylori
SKESLMHAINSIRVGMHFKELSQILESTITERGFVPLKGFCGHGIGKKPHEEPEIPNYLEKGVKPNSGPKIKEGMVFCLEPMVCQKQGEPKILADKWSVVSVDGLNTSHHEHTIAIVGNKAVILTER

SEQ ID NO: 239 - DNA, 242 bp, Helicobacter pylori
  CDS (1)..(240)
cagctcagcggtgggcaaaaacaacgagtggcgatcgctaggagtttagcgaattgccctgatttattgctttgcgatgaagccacatccgcgctagattctaaaaccacgcattctattttaacgcttttaagcggcattcaaaaaaagcttgatttgagcatcgttttcatcacgcatgaaattgaagtggttaaagaattgtgcaatcaaatgtgcgtgatcagcagcggcgaaatcgt

SEQ ID NO: 240 - protein, 80 aa, Helicobacter pylori
QLSGGQKQRVAIARSLANCPDLLLCDEATSALDSKTTHSILTLLSGIQKKLDLSIVFITHEIEVVKELCNQMCVISSGEI

SEQ ID NO: 241 - DNA, 471 bp, Helicobacter pylori
  CDS (1)..(471)
tatggcaagcaaagcttgagttcttttgccaataattttgtgcctggaggcttgaatcaagcccttgataaaataggctctagctctgatgccaaagacttacagaacttcttggataaaacgacttttggggatattttaaatcaaatgattgaacaagcccccttaatcaataaactcatttcttggctgggtccgcaggatttgagcgttttagtgaatatcgctttaaatagcatcactaaccctagtaaagagctgactagcaccatttctagcataggtgaaaaagcgttaaatgacttattaggcgatggcgtagtgaataaaatcatgagcaatcaagtcttagggcaaatgatcaataaaatcattgctgataagggctttggaggcgtttatcagcaaggtttaggctccatactgcctcaatctttacaagatgaattgaagaaattgggcatgggctct

SEQ ID NO: 242 - protein, 157 aa, Helicobacter pylori
YGKQSLSSFANNFVPGGLNQALDKIGSSSDAKDLQNFLDKTTFGDILNQMIEQAPLINKLISWLGPQDLSVLVNIALNSITNPSKELTSTISSIGEKALNDLLGDGVVNKIMSNQVLGQMINKIIADKGFGGVYQQGLGSILPQSLQDELKKLGMGS

SEQ ID NO: 243 - DNA, 278 bp, Helicobacter pylori
  CDS (1)..(276)
gggaatatcaccgttgatgggcctttaagagtgaataatcaagtgggtggttatgctttggcaggatcaagcgcgaattttgagtttaaggctggtacggataccaaaaacggcacagccacttttaataacgatattagtttgggaagatttgtgaatttaaaagtggatgctcatacagctaattttaaaggtattgatactggtaatggtggtttcaacaccttagattttagtggcgttacaggtaaggtcaatatcaacaagctcattacggc

SEQ ID NO: 244 - protein, 92 aa, Helicobacter pylori
GNITVDGPLRVNNQVGGYALAGSSANFEFKAGTDTKNGTATFNNDISLGRFVNLKVDAHTANFKGIDTGNGGFNTLDFSGVTGKVNINKLIT

SEQ ID NO: 245 - DNA, 901 bp, Helicobacter pylori
  CDS (1)..(900)
aatggcgcgagtggtacaggcagtgggaatggcaccagtcaaatcaacacagcctaccagatgctcacagacgccagcgatgggaaattagggacttatagtagtagtagtggcagtaataacggctatacgccatgcaatagcaccaatgggagcaataaaacgagtgggaacaattgttatgaacccaacaaacaacaaaacgccaccaccgcaaccgccacaaccgacagcaatttacaaaaagtctataatgacgcccaaaaaatagccaacattatcgccagctctgggaacaataaaggcgttgaaaacggcttaaaacaattctttgaagcgttaaaaaataatagcagcagtctcagtaatttatgtggtaatggtagtagcggtagtagtggcactacttgctccggttggcttatcaaccttttaggggcaatccccaccaatggagtgagcgatacgaataatttaattaatctgctcactgaattcattaaaaccgccgggtttatccaaaataatgatagtagtgtatctactagtcttacaagcgcttttcaagccattacgagcgctatttctcaagggtttcaagccttacaaaacgatattagccctaatgcgattttaaccttgctccaagagattacttctaacaccaccaccattcagtcattctcgcaaaccttacggcagcttttaggggataaaacattctttatggcgcaacaaaagctcattgatgcgatgattaacgccagaaatcaggttcaaaacgcgcaaaatcaagccaataactacggctctcaacccgttttaagccagtatgcggccgctaaaagcacccaacatggcatgagcaatggtttaggggttggtttgggctataaatact

SEQ ID NO: 246 - protein, 300 aa, Helicobacter pylori
NGASGTGSGNGTSQINTAYQMLTDASDGKLGTYSSSSGSNNGYTPCNSTNGSNKTSGNNCYEPNKQQNATTATATTDSNLQKVYNDAQKIANIIASSGNNKGVENGLKQFFEALKNNSSSLSNLCGNGSSGSSGTTCSGWLINLLGAIPTNGVSDTNNLINLLTEFIKTAGFIQNNDSSVSTSLTSAFQAITSAISQGFQALQNDISPNAILTLLQEITSNTTTIQSFSQTLRQLLGDKTFFMAQQKLIDAMINARNQVQNAQNQANNYGSQPVLSQYAAAKSTQHGMSNGLGVGLGYKY

SEQ ID NO: 247 - DNA, 147 bp, Helicobacter pylori; identical to SEQ ID NO: 41
  CDS (1)..(147)

SEQ ID NO: 248 - protein, 49 aa, Helicobacter pylori; identical to SEQ ID NO: 42

SEQ ID NO: 249 - DNA, 249 bp, Helicobacter pylori
  CDS (1)..(249)
tccaagctggatttgaaagacatttatgcgtttttaaaaaatttagacaaagaaaattttgattccagagaaaatcagagggaaaggattgaaagcctgttagagagcgttaacaggcataagatccccttaaacgagcaagaattgcaagcctttgatttagcgatcaaggctaacagctcttattacaagctcagctataatcttttacccctgcttttaagccttttatccaaaaagaaaacgcca

SEQ ID NO: 250 - protein, 83 aa, Helicobacter pylori
SKLDLKDIYAFLKNLDKENFDSRENQRERIESLLESVNRHKIPLNEQELQAFDLAIKANSSYYKLSYNLLPLLLSLLSKKKTP

SEQ ID NO: 251 - DNA, 618 bp, Helicobacter pylori
  CDS (1)..(618)
gagtttagaagttttatagacaagcattataaccactcttttgagccgctagaggttttaggctatatttatgcgttattgtattccccaaactaccgcaagcgttatgaagacttccttaaaaacgattaccctaaaatccttttcacaaacaataaagatttgtttagggctttaagccttttagggattgaactaatcggcttgcatgtcttaaaccaagaaagcctgaattacagctttggaaaattaaaagacgccaccataggcgaatcctgctataaagaagagcataaccccatcatcaaaaaaccctctcataacgagccagaccaacggctttatatcaaccatagcgcttattttaggggggtgagtcaagaaatttatgattatagaataggggggtatggcgttttagacaaatatttaaaaagccataaaaacgagccttgcgactttgatcatgtaactaatatcattaaagtcatcgcacgcacgattgaaatccaaaaaacgcttggatttttaacgagcgatttgccccatttaaaagggaatgacagcaaagccttaatgcaagaaatcttgcaaaatccacccccccccccccccatt

SEQ ID NO: 252 - protein, 206 aa, Helicobacter pylori
EFRSFIDKHYNHSFEPLEVLGYIYALLYSPNYRKRYEDFLKNDYPKILFTNNKDLFRALSLLGIELIGLHVLNQESLNYSFGKLKDATIGESCYKEEHNPIIKKPSHNEPDQRLYINHSAYFRGVSQEIYDYRIGGYGVLDKYLKSHKNEPCDFDHVTNIIKVIARTIEIQKTLGFLTSDLPHLKGNDSKALMQEILQNPPPPPPI

SEQ ID NO: 253 - DNA, 1269 bp, Helicobacter pylori
  CDS (1)..(1269)
tttgacagagaaagaatccctgaaagggtggtgcatgctaaaggaagcggagcttatggcactttcactgtgactaaagacatcactaaatacactaaagcgaaaattttctctaaagtgggcaaaaaaaccgaatgcttcttcagattttctactgtggctggtgaaagaggcagtgcggatgcggtgagagaccctagaggttttgcgatgaagtattacactgaagaaggtaactgggatttagtggggaacaacacgcctgttttctttatccgtgatgcgatcaaattccctgatttcatccacactcaaaaacgagatcctcaaaccaatttgcctaaccatgacatggtatgggatttttggagtaatgttcctgaaagcttataccaagtaacatgggttatgagcgataggggtattcctaaatctttccgccacatggatggttttggcagccacactttcagtcttatcaacgcgaaaggcgaacgcttttgggtgaaattccactttcacaccatgcaaggcgttaagcatttgactaacgaagaagccgcagaagttaggaagtatgatccggattccaatcaaagggatttattcaatgcgatcgctagaggggatttcccaaaatggaaattaagcattcaagtgatgccagaagaagatgctaagaagtatcgattccatccgtttgatgtaactaaaatttggtatctccaagattatccattgatggaagtgggcattgtggagttgaataaaaatcctgaaaactatttcgcagaagtggaacaagcggcattcagtccggctaatgtcgttcctggaattggctatagccctgataggatgttacaagggcgcttgttctcttatggagacacacaccgctaccgcttaggcgttaattatcctcaaataccggttaataaaccaagatgcccattccactcttctagcagagatggttacatgcaaaacggatactacggctctttacaaaactatacgcctagctcattgcctggctataaagaagataagagcgcgagagatcctaagttcaacttagctcatattgagaaagagtttgaagtgtggaattgggattacagagctgatgatagcgattactacacccaaccaggtgattactaccgctcattgccagctgatgaaaaagaaaggttgcatgacactattggagagtctttagctcatgttacccataaggaaattgtggataaacaattggagcat

SEQ ID NO: 254 - protein, 423 aa, Helicobacter pylori
FDRERIPERVVHAKGSGAYGTFTVTKDITKYTKAKIFSKVGKKTECFFRFSTVAGERGSADAVRDPRGFAMKYYTEEGNWDLVGNNTPVFFIRDAIKFPDFIHTQKRDPQTNLPNHDMVWDFWSNVPESLYQVTWVMSDRGIPKSFRHMDGFGSHTFSLINAKGERFWVKFHFHTMQGVKHLTNEEAAEVRKYDPDSNQRDLFNAIARGDFPKWKLSIQVMPEEDAKKYRFHPFDVTKIWYLQDYPLMEVGIVELNKNPENYFAEVEQAAFSPANVVPGIGYSPDRMLQGRLFSYGDTHRYRLGVNYPQIPVNKPRCPFHSSSRDGYMQNGYYGSLQNYTPSSLPGYKEDKSARDPKFNLAHIEKEFEVWNWDYRADDSDYYTQPGDYYRSLPADEKERLHDTIGESLAHVTHKEIVDKQLEH

SEQ ID NO: 255 - DNA, 1005 bp, Helicobacter pylori
  CDS (1)..(1005)
agcattatttatcccctttatatgggtggggcaagattcacgatggtgcgcattgcggatttgatgcaaaaagatgctaatgaagtgtatcgtttgaaaaagctttccacttttcaagagcttgtgagcgtgtattacggcatggtgttaaacgcagaagtggctgaaactttagaagaggtggaaaaaggccattataagcatttccaaaacgctttgaaaatgcaaaaagtggggcaaatcgctagggtagaaaccttaggcgctcaagtggcttatgataaggcccatatcgctagcgttaaggctaaagacgtgttagaagtttcgcagctctcgttcaattccattttatctagcaaggacgatttagtgccttcaagcaaattagagatccgcacggagaaaaatctgcccgatctgagcttttttgtttcttccacgctcaattcctacccggttttaaagactttagaaaatcagattcaaatctctaaagaaaacacgaaattacagatcgctaaattcttgccccaagtgagtttttttggctcttatattatgaagcaaaacaattcggtgtttgaagacatgatccctagttggtttgtgggcgtggccgggcgcatgcctattctttctcccacagggcgcattcaaaaataccaagcgagcaaattagcggagttgcaagtgagtagcgaacaaatccaggctaaaaaaaacatggaattattagtgaataagacttataaagagacgctttcttatttgaaagaatacaaaagcttgctttctagcgtggaattagccaaggaaaacttaaaactccaagagcaggcttttttacaaggcttaagcacgaacgctcaagtcattgatgcgaggaacacgctttcttctatcgtcgtggagcaaaaaagcgtggcttataaatacatcgtttcattagcgaatttaatggcgttaagcgatcatattgatttattttatgaatttgtttat

SEQ ID NO: 256 - protein, 335 aa, Helicobacter pylori
SIIYPLYMGGARFTMVRIADLMQKDANEVYRLKKLSTFQELVSVYYGMVLNAEVAETLEEVEKGHYKHFQNALKMQKVGQIARVETLGAQVAYDKAHIASVKAKDVLEVSQLSFNSILSSKDDLVPSSKLEIRTEKNLPDLSFFVSSTLNSYPVLKTLENQIQISKENTKLQIAKFLPQVSFFGSYIMKQNNSVFEDMIPSWFVGVAGRMPILSPTGRIQKYQASKLAELQVSSEQIQAKKNMELLVNKTYKETLSYLKEYKSLLSSVELAKENLKLQEQAFLQGLSTNAQVIDARNTLSSIVVEQKSVAYKYIVSLANLMALSDHIDLFYEFVY

SEQ ID NO: 257 - DNA, 296 bp, Helicobacter pylori
  CDS (1)..(294)
gaaatcattagagatattgctgatcaaaccaatcttttagccttaaacgccgctattgaagccgcaagggccggcgagcatggcagaggctttgcggtggtggctgatgaggtaagaaagctcgctgaaaggacgcaaaaatcgctcagcgagattgaagccaatatcaatattttagtgcaaagcatttcagacacgagcgaaagcattaaaaaccaggttaaagaagtggaagaaatcaacgcttctattgaagccttaagatcggttactgagggcaatctaaaaatcgctag

SEQ ID NO: 258 - protein, 98 aa, Helicobacter pylori
EIIRDIADQTNLLALNAAIEAARAGEHGRGFAVVADEVRKLAERTQKSLSEIEANINILVQSISDTSESIKNQVKEVEEINASIEALRSVTEGNLKIA

SEQ ID NO: 259 - DNA, 430 bp, Helicobacter pylori
  CDS (1)..(429)
attcaagctttactcgtgggcgttcaagaagaatattacgctatcccgctttcttcagtgttagaaaccgtgcgcatcagccaggatgaaatttacaccgttgatggcaagagcgtgttgcgtttgagagatgaggtgctttctttggtgcgcctttctgatatttttaaagtagatgctattttggaatccaactcagatgtgtatgtggttatcattggcttggctgatcaaaaaattggcgtgatcgtggattatttaatcggtcaagaagaagtggtcattaaatctttaggttactatcttaaaaacactagaggcattgctggtgctacggtgagaggcgatgggaaaatcacccttattgtagatgtgggggcgatgatggatatggcaaaaagcatcaaggtcaatatcactaccttaatga

SEQ ID NO: 260 - protein, 143 aa, Helicobacter pylori
IQALLVGVQEEYYAIPLSSVLETVRISQDEIYTVDGKSVLRLRDEVLSLVRLSDIFKVDAILESNSDVYVVIIGLADQKIGVIVDYLIGQEEVVIKSLGYYLKNTRGIAGATVRGDGKITLIVDVGAMMDMAKSIKVNITTLM

SEQ ID NO: 261 - DNA, 497 bp, Helicobacter pylori
  CDS (1)..(495)
aaaattggagtttgtggtcctgtaggaagcggtaaaaccgccttgattgaagctttaacgcgccacatgtcaaaagattatgacatggcggtcatcactaatgatatttacacgaaagaagacgcagagtttatgtgtaaaaattcggtgatgccacgagagaggatcattggcgtagaaacaggaggctgtccgcacacggctattagagaagacgcttctatgaatttagaagccgtagaagaaatgcatggccgtttccctaatttggaattgcttttgattgaaagcggaggcgataacctttcagcgacattcaacccagagctagcggactttacgatctttgtgattgatgtggctgagggcgataaaatcccccgaaaaggcgggccaggaatcacgcgctcagacttgcttgtcatcaataagattgatttagccccctatgtgggagcggacttgaaagtcatggaaagggattctaaaaaaatgcg

SEQ ID NO: 262 - protein, 165 aa, Helicobacter pylori
KIGVCGPVGSGKTALIEALTRHMSKDYDMAVITNDIYTKEDAEFMCKNSVMPRERIIGVETGGCPHTAIREDASMNLEAVEEMHGRFPNLELLLIESGGDNLSATFNPELADFTIFVIDVAEGDKIPRKGGPGITRSDLLVINKIDLAPYVGADLKVMERDSKKM

SEQ ID NO: 263 - DNA, 402 bp, Helicobacter pylori
  CDS (1)..(402)
tttaaaaccaggcaaggcaaagacatagccatacgccttaaagacgctcccaagttggggctctctcaaggggatattttatttaaagaagagaaggaaattatcgccgttaatatcttggattctgaagtcattcacatccaagccaagagcgtggcagaagtagcgaaaatatgctatgaaataggaaaccgccatgcggctttatactatggcgagtctcaatttgaatttaaaacaccatttgaaaagcccacgctagcgttattagaaaagctaggggttcaaaatcgtgttttaagttcaaaattggattccaaagaacgcttaaccgtgagcatgccccatagtgagcctaattttaaggtctcactagcgagcgattttaaagtggtcgtaaaa

SEQ ID NO: 264 - protein, 134 aa, Helicobacter pylori
FKTRQGKDIAIRLKDAPKLGLSQGDILFKEEKEIIAVNILDSEVIHIQAKSVAEVAKICYEIGNRHAALYYGESQFEFKTPFEKPTLALLEKLGVQNRVLSSKLDSKERLTVSMPHSEPNFKVSLASDFKVVVK

SEQ ID NO: 265 - DNA, 606 bp, Helicobacter pylori
  CDS (1)..(606)
attaaaagagcggcaaaggaattgaaagagggcatgtatgtgaatttagggataggcttgcccacgcttgtggctaatgaagtgagcgggatgaatatcgttttccaaagcgagaacgggctgttagggattggcgcttaccctttagaggggagcgttgatgcggatcttatcaacgcaggaaaggaaaccataaccgtggtgccgggcgcttcgtttttcaatagcgcggattcgtttgcgatgattcgtggggggcatattgatttagcgattttaggggggatggaagtctcacaaaatggggatttggctaattggatgatccctaaaaagctcataaagggcatgggaggggctatggatttggtgcatggcgctaaaaaagtgattgtgatcatggagcattgcaacaaatacggggagtctaaagtgaaaaaggaatgctcattgcccttaacaggaaaaggcgtggtgcatcaattgataacggatttagcggtgtttgagttttccaataacgccatgaaattagtggaattgcaagagggggtcagccttgatcaagtgaaagaaaagacagaagctgaatttgaggtgcgctta

SEQ ID NO: 266 - protein, 202 aa, Helicobacter pylori
IKRAAKELKEGMYVNLGIGLPTLVANEVSGMNIVFQSENGLLGIGAYPLEGSVDADLINAGKETITVVPGASFFNSADSFAMIRGGHIDLAILGGMEVSQNGDLANWMIPKKLIKGMGGAMDLVHGAKKVIVIMEHCNKYGESKVKKECSLPLTGKGVVHQLITDLAVFEFSNNAMKLVELQEGVSLDQVKEKTEAEFEVRL

SEQ ID NO: 267 - DNA, 336 bp, Helicobacter pylori
  CDS (1)..(336)
gggattgaacaagacgctgatattgttttatttttatatagaggctatatctatcaaatgagggctgaagacaacaaaatagacaaactcaaaaaagaaggtaaaattgaagaggcgcaagagttgtacttaaaagttaatgaagaaaggcgtatccacaagcaaaatggcagcattgaagaggctgaaatcattgtggctaaaaacaggaatggggctacaggaacggtttatacgcgctttaacgctcctttcacgcgctatgaagacatgcccatagattcccatttagaagaagggcaagaaactaaagtggattatgatatagttacaact

SEQ ID NO: 268 - protein, 112 aa, Helicobacter pylori
GIEQDADIVLFLYRGYIYQMRAEDNKIDKLKKEGKIEEAQELYLKVNEERRIHKQNGSIEEAEIIVAKNRNGATGTVYTRFNAPFTRYEDMPIDSHLEEGQETKVDYDIVTT

SEQ ID NO: 269 - DNA, 240 bp, Helicobacter pylori
  CDS (1)..(240)
aatgcgattgagcaagatgaaatcactaaaaaaattgaagcagaagagttgttagagcatgtccaaaaagcgctgaatcaaatgagcgaaagagagcaaatccttatccagctttattactttgaagagttgaatttgagcgagattaaagagattttaggcattactgaatcgcgcatttctcaaatcattaaagaagtgattaaaaaggtgcgtaaatccttaggagtggatcatggc

SEQ ID NO: 270 - protein, 80 aa, Helicobacter pylori
NAIEQDEITKKIEAEELLEHVQKALNQMSEREQILIQLYYFEELNLSEIKEILGITESRISQIIKEVIKKVRKSLGVDHG

SEQ ID NO: 271 - DNA, 219 bp, Helicobacter pylori
  CDS (1)..(219)
gttgatgaaaaaaagggtcatttgattttaggggaggtggagcaggataatggcgtgtttgaaagcagtggggggagggtgatctttgccattggtaggggaaaatccttattagaagccagaaaccatgcttatgaaatcgctcaaaaggtgcattttgaaggcatgttttatcgcaaggatattggttttaaggtgttagatttgaaagaatattct

SEQ ID NO: 272 - protein, 73 aa, Helicobacter pylori
VDEKKGHLILGEVEQDNGVFESSGGRVIFAIGRGKSLLEARNHAYEIAQKVHFEGMFYRKDIGFKVLDLKEYS

SEQ ID NO: 273 - DNA, 672 bp, Helicobacter pylori
  CDS (1)..(672)
aaagacgatttagcggaaatcatgcttttagcggtaagccctggcatgatgaggggcgatgcgcaagatgtgcaattaaacatcggtccaaattgcaagttaaggatcacttcgcaatcctttgaaaaaatccataacactgaagatgggtttgccagcagagacatgcatattgttgtgggggaaaacgcttttttagattttgcgcctttcccgttaatcccctttgaaaacgcgcattttaagggcaacaccacgatttctttgcgctctagctctcaattgctctatagtgaaatcattgtcgcagggcgagtggcgcgcaatgagttgtttaaattcaaccgcttgcacaccaaaatctctattttacaagatgagaaacccatctattatgacaacacgattttagatcccaaaaccaccgacttaaataacatgtgcatgtttgatggctatacgcattatttgaatttggtgcttgtcaattgccccatagagctctctggtgtgcgagaatgcattgaagaaagcgaaggggtggatggggcagtgagtgaaaccgctagttctcatttatgcgtgaaagctttagcgaaaggctcagaacccttattgcatttaagagaaaaaatcgctcgcttggttacgcaaaccaccacgcaaaaggtt

SEQ ID NO: 274 - protein, 224 aa, Helicobacter pylori
KDDLAEIMLLAVSPGMMRGDAQDVQLNIGPNCKLRITSQSFEKIHNTEDGFASRDMHIVVGENAFLDFAPFPLIPFENAHFKGNTTISLRSSSQLLYSEIIVAGRVARNELFKFNRLHTKISILQDEKPIYYDNTILDPKTTDLNNMCMFDGYTHYLNLVLVNCPIELSGVRECIEESEGVDGAVSETASSHLCVKALAKGSEPLLHLREKIARLVTQTTTQKV

SEQ ID NO: 275 - DNA, 477 bp, Helicobacter pylori
  CDS (1)..(477)
caaaaggataaatcttacaaggttgttgaagaataccccagctcaagaacccacattatagtgcgcgatttgcaaggcaatgaacgcgtgttaagcaatgaagagattcaaaagctcatcaaagaagaagaagctaaaattgataacggcacgagcaagcttgtccagcctaataatggagggagtaatgaaggctcaggctttggcttggggagcgcgattttagggagcgcggcgggggcgattttagggagttatattggtaataagcttttcaataaccctaattaccagcaaaacgcccaacggacctacaaatccccacaagcttaccaacgctctcaaaattccttttctaaaagtgcgcccagtgcttcaagcatgggcggagcgagtaagggacagagcgggttttttggctctagtaggcctactagttcaccggcggtaagctctgggacaaggggctttaactca

SEQ ID NO: 276 - protein, 159 aa, Helicobacter pylori
QKDKSYKVVEEYPSSRTHIIVRDLQGNERVLSNEEIQKLIKEEEAKIDNGTSKLVQPNNGGSNEGSGFGLGSAILGSAAGAILGSYIGNKLFNNPNYQQNAQRTYKSPQAYQRSQNSFSKSAPSASSMGGASKGQSGFFGSSRPTSSPAVSSGTRGFNS

SEQ ID NO: 277 - DNA, 685 bp, Helicobacter pylori
  CDS (1)..(684)
accgctcaaacccttttaaaccatgctaaaaaaactcaaagcttgaatggggtggagattgtagggttggagcatttggataaagtgatttatttagatcaagcccccataggcaaaaccccacgaagcaaccctgccacttacacgggagtgatggatgaaatcaggattttatttgccgagcaaaaagaagctaaaattttaggctatagtgcgagccgttttagctttaatgttaaaggagggcggtgcgagaaatgccaaggcgatggggacattaaaatagaaatgcactttttgcctgatgtgttagtccaatgcgatagctgtaagggcgctaaatacaacccccaaactttagaaatcaaggtgaaaggcaaatccattgccgatgtgttgaacatgagcgtggaagaggcttatgaattttttgctaaattccctaaaatcgccgtgaagttaaaaacgcttatggatgtgggcttaggctatatcactttagggcaaaacgctacgactttaagtgggggggaggctcaaaggatcaaattagctaaagaattgagtaaaaaagacacaggcaaaaccctttatattttagatgagcctactaccggtttgcattttgaagacgtgaatcatcttttacaagtcttgcattctttagtggcgttaggcaattcta

SEQ ID NO: 278 - protein, 228 aa, Helicobacter pylori
TAQTLLNHAKKTQSLNGVEIVGLEHLDKVIYLDQAPIGKTPRSNPATYTGVMDEIRILFAEQKEAKILGYSASRFSFNVKGGRCEKCQGDGDIKIEMHFLPDVLVQCDSCKGAKYNPQTLEIKVKGKSIADVLNMSVEEAYEFFAKFPKIAVKLKTLMDVGLGYITLGQNATTLSGGEAQRIKLAKELSKKDTGKTLYILDEPTTGLHFEDVNHLLQVLHSLVALGNS

What is claimed is:

1. A method for producing a collection of recombinant cell clones usable for two-hybrid systems comprising the steps of:
    a) fragmenting genomic DNA obtained from a prokaryotic micro-organism;
    b) inserting polynucleotidic fragments obtained in step a) in plasmids in such a way that the expression of sad plasmids in a host cell leads to a first hybrid polypeptid containing a specific domain which activates the transcription of a reporter gene when associated with a complementary domain of a second hybrid polypeptide
    c) transforming cell clones with plasmids obtained in step b); and
    d) selecting the transformed recombinant cell clones obtained in step c).

2. The method of claim 1, wherein the step a) of fragmenting DNA is carried by a nebulization process.

3. The method of claim 1 or 2, wherein the prokaryotic micro-organism is *Helicobacter pylori*.

4. The method of claim 1 or 2, wherein the prokaryotic micro-organism is *Escherichia coli*.

* * * * *

UNITED STATES PATENT AND TRADEMARK OFFICE
CERTIFICATE OF CORRECTION

PATENT NO. : 6,916,615 B2
DATED : July 12, 2005
INVENTOR(S) : Pierre Legrain, Luc Selig and Jean-Christophe Rain It is certified that error appears in the above-identified patent and that said Letters Patent is hereby corrected as shown below:

Title page,
Item [57], ABSTRACT,
Line 5, "then" should read -- the --.

Column 1,
Line 60, after "although", insert --a --.
Line 65, "spiral shaped" should read -- spiral-shaped --.

Column 3,
Line 25, "genome" should read -- genomes --.
Lines 32-33, "therapeutic" should read -- therapeutics --.
Line 40, after "to" insert -- a --.

Column 4,
Lines 5, 8, 11 and 14, "detailled" should read -- detailed --.

Column 5,
Line 64, after "to" insert -- a --.

Column 6,
Lines 44, 52 and 60, "pourcentage" should read -- percentage --.
Line 66, "independant" should read -- independent --.

Column 7,
Line 57, "vial" should read -- vials --.
Line 59, "provides a generally" should read -- generally provides a --.

Column 8,
Line 27, "theses" should read -- these --.

Column 10,
Line 60, "firstly" should read -- first --.

Column 11,
Line 51, after "invention" delete ",".

Column 12,
Line 44, after "invention" delete ",".

UNITED STATES PATENT AND TRADEMARK OFFICE
CERTIFICATE OF CORRECTION

PATENT NO. : 6,916,615 B2
DATED : July 12, 2005
INVENTOR(S) : Pierre Legrain, Luc Selig and Jean-Christophe Rain It is certified that error appears in the above-identified patent and that said Letters Patent is hereby corrected as shown below:

Column 13,
Line 19, after "account" deleted "of".
Line 22, "an" should read -- a --.
Line 44, "other databank." should read -- other databanks --.

Column 14,
Line 4, after "method" delete ",".
Lines 25 and 35, "are" should read -- is --.
Line 26, "is" should read -- are --.

Column 15,
Line 33, "self replicated" should read -- self-replicated --.
Line 35, "an" should read -- a --.
Line 40, "Vector" should read -- Vectors --.
Line 59, "self replicating" should read -- self-replicating --.

Column 16,
Line 50, after "cells" delete ",".

Column 20,
Lines 36-37, "is also part of the invention a modulator agent" should read -- a modulator agent is also part of the invention --.

Column 21,
Line 48, "to" should read -- for --.

Column 22,
Line 53, after "interaction" delete ",".
Line 64, after "invention" delete ",".

Column 23,
Line 8, "wells" should read -- well --.
Line 67, after "adjuvant" delete ",".

Column 27,
Line 5, "digest" should read -- digested --.

Column 28,
Line 1, "protocole" should read -- protocol --.

UNITED STATES PATENT AND TRADEMARK OFFICE
CERTIFICATE OF CORRECTION

PATENT NO. : 6,916,615 B2
DATED : July 12, 2005
INVENTOR(S) : Pierre Legrain, Luc Selig and Jean-Christophe Rain It is certified that error appears in the above-identified patent and that said Letters Patent is hereby corrected as shown below:

Column 31,
Line 54, "names" should read -- name --.

Column 32,
Line 23, "fragments that are" should read -- fragment that is --.

Column 39,
Line 23, "polypeptid" should read -- polypeptide --.
Line 26, after "polypeptide" insert -- ; --.

Signed and Sealed this

Seventh Day of February, 2006

JON W. DUDAS
*Director of the United States Patent and Trademark Office*